United States Patent 11,446,398 (REGULATED BIOCIRCUIT SYSTEMS) - sequence listing, part 83

SEQ ID NO: 187575 - DNA, 5848 bp, Homo sapiens
  Payload ID: 16920
  Gene Symbol: SOCS6
  Gene Name: suppressor of cytokine signaling 6
  Uniprot ID: O14544
  ENST ID: ENST00000397942
  CDS Start-End: 317-1924
agtagtggacggggggcggcccgctcggctcctccgcacccgctccccgctcgggccgaggcgccgcggccgcgcgcccctcctggaggaggaggaggaaggaggcgggaggaggagttgccgagaggagaaggcgagcgcggcagtcgcgccggcgctgggcgaggaagcggagccgggccgcctccggaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgatcatagcttcctgtgatagcatttttttgtgtgttacctatccttttggtaaaatgttttatctgtgatttctttagcttagtcaacattttcttgggtgaacttgattgtcaactaattttcataaatggactggattctcttgcaacattaatgtttataaaaagttttaaattgatttgaatagaaagaaaacattgttttaaagttggatttatatttttcttctatgtagttactataaaagtgtgctggatttgaccaatccttacccccactataaagagaacccgtgatgactttagtttaaaaattgtggaaattgtggagcaatttttctcacaatgtgagaaaaattctaaaccatattagataatgtggaagtcatattgtctatcatatatactgccatttaaaaataggtttttaaaatttagctaagtcttaagtaatttgccgttgctaataattttatctccttgagtcggttgttggggagagatgttatattcaataatttttagttattttgtaatgcagagtgtttattcatttcacagttctgcaatggatgtagtattttgggattgccctgtccagaaaattttcagctacacacctttaaaggaaaatgtttctatctcagatgaaacatgtaatttgggatggttcttcctttgtcacttaaaggaagagataggaaaagtctcttacccactttaaacatgagggtaaaggtttaggtcaaacttactggctttgtcattcaagcatatctgaatcctcacttttttctctttgctttttagggtcagaactgagatattaccaagaaaaggcacaatgccataatattatggtgttatggtattttgacttaaaggggaaaaggtacttaattttggtgggatgttgattgtaccttgttaaaaagactctcattttctcatatgttttctcctaataagatggaatatggagtatactgtaataatataagtgttcattataagctatttggattaagaactattgcagagttgtaagcttgttatcaaattaatgcaagacatttaaactatttttttgcaaaactatttatttttaaaacaacttaaagtatatctagggtgagttaaaagtccctgtgcatctatattagatggcaggttttgtcacagagtcactgtgtattaataataaatgttgaaatggcttctccgtgtctccagaagcatttacatgtcctccttgtgagatcatggtgcacagaggtctttggactgccctgaacccgtcttatgtggacataacctattcccttcgttttctcatcatgccatgtgtttaagatctacccgcttagtgtcaagattattgagattttcatctaaatgtttttaaaattgtattttgtgttttagtggaggacagtcttgatactgttctaattcagaaagccaaattttgatgcgcttttgtatattcataatatatactttaatatgccctattctaatctagtttgaaattgttagattctgatagtataatgataaaatcaaactatttgccaaaaagttaaatttacaagcagaaagatgttttgcgatattttctacttttgtgtagaaagataaccatttggggtaggcagcacaacagaatgtgaaagattggctttatatgatactaacacagtccagttaaaagtggaaacagggaaaagagagagagaaaactcatcatttagtttggtctagacacaatttggttaaattttaggattctattggcagttaacatagatgacatggacacagcctatgagtgctttttaaatacgtgcttctaaaaatctgagctcaaagcaagaaaaagaaaacaggaaagctgtatccatttgccataatagatgaatcagaattgttttctattaaatatttcatcacgaaatatgatggaggccagaagctatttttaggcttactataacactattatgcatttttataaataagaagaaggctgtagaaagtacttgaaaaatatctaattctctttctgtctaaggaaaactctttctacttggtgcaataatctgaaaatttagaaggtcaaaatatgtcacaggaaatgatcatagacctaaaaatagtttttaaggaaaccagctacacggggcaaccaaccatcttgctgttgaagaaaacagttccaaaaggctaaatcattggcataaaggaaacaaaacccaaagtatgcgttgtaattcttgagccagtattactgaaacaggataaaagttataaaatctaacataggttaatgcaatgtctctgctagtgctacaagtctaaaatatctttgtaacaatgctttcagaaatgccagttttaattacatttcacattgtatatgagagatactgctttatgaatgaatcggaataatacattttcatttaaatcttaattgcttttcattaaatgcgaagtcttaatttcaaaatgaaatcacactaccagcaatagacagttttcttgaaaactctaataaggaacaatagccagttccgtaaataactttaaaattctaaaagtgttggtacactagcaatcacaaatatggtttcttttaatacttttttaatcctgtaaagaagggtttttataaacattctttttattaatcagtcataacatggcgaagtgtgtagttgctgtttctgaaaagtgatccaaactctacatccagagattatgaaaaattcttatagaattttgtaacaagtatttacatgttgggtgaaagaaatttcatagtcgttggagtgccatgaaattaatacttgcaattcagattgcggtagtttacactttttctgtatgtttcaaatcaggtgtgtaccatttgtactgagaacaccacagaatgaattatccaaagtccattgattttaatacgtgttttggtttgtaaacaaattatagtaatttcttgcacatttttggaaattaattgtataagaatttatgtatctgcttctagatacagtgtgtaaataaaaaatttcgttcacaagac

SEQ ID NO: 187576 - DNA, 894 bp, Homo sapiens
  Payload ID: 16920
  Gene Symbol: SOCS6
  Gene Name: suppressor of cytokine signaling 6
  ENST ID: ENST00000578377
  CDS Start-End: 212-894
cttggaatattgcaggcattgctccgttgtcgtccggttttcagtgttactgttaagtcacatgccgccagtttcccaggcagttaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttaga

SEQ ID NO: 187577 - DNA, 2625 bp, Homo sapiens
  Payload ID: 16920
  Gene Symbol: SOCS6
  Gene Name: suppressor of cytokine signaling 6
  Uniprot ID: O14544
  ENST ID: ENST00000582322
  CDS Start-End: 178-1785
aggttgcagtgagctgagatggcaccaccacactccagcctgggcgacagaaaaatggctccaaaggttaaatgaagcaggaaaaatacatagatgcagccttgcagcctctccagatgtttggggataatattccagatagaaatattgatcccttggattaggtaactagtcataatgaagaaaattagtcttaaaaccttacggaaatcttttaacttgaataaaagtaaagaagaaactgatttcatggtagtacaacaaccatcgctagccagtgactttggaaaagatgattccttatttggtagctgctatggtaaagatatggccagctgcgatatcaacggtgaagatgaaaaaggcggaaaaaacagatcaaaaagcgagagcctgatgggtacgctaaaaaggcggctttctgcaaaacagaagtcaaaaggcaaggcgggcacaccctctgggagctctgccgacgaggacaccttctcctcctcctcagcacccatagtctttaaagacgtgagagctcagaggccgataaggtccacgtcgctccgcagccatcactacagtcccgcgccgtggcctctgcggcccacaaactccgaggagacctgcatcaagatggaggtgagagtcaaggccttggttcactcttccagcccgagtccagccctgaatggcgtccggaaggatttccacgacctccagtctgagaccacgtgccaggagcaagccaattcactgaagagctcggcttctcataatggagacctgcatcttcacctggatgaacatgtgcctgtcgttattggacttatgcctcaggactacattcagtatactgtgcctttagatgaggggatgtatcctttggaaggatcacggagctattgtctggacagctcttctcccatggaagtctctgcggttcctcctcaagtgggagggcgcgctttccccgaggatgagagtcaggtagaccaggacctagttgtcgccccagagatcttcgtggatcagtccgtgaatggcttgttgattggcaccacgggagtcatgttgcagagcccgagagcgggtcacgatgatgtccctccactctcaccattgctacctccaatgcagaataatcaaatccaaaggaacttcagtggactcactggcacagaagcccacgtggctgaaagtatgcgctgtcatttgaattttgatccgaactctgctcctggggttgcaagagtttatgactcagtgcaaagtagtggtcccatggttgtgacaagccttacagaggagctgaaaaaacttgcaaagcaaggatggtactggggaccaatcacacgttgggaggcagaagggaagctagcaaacgtgccagatggttcttttcttgttcgggacagttctgacgaccgttaccttttaagcttgagctttcgctcccatggtaaaacacttcacactagaattgagcactcaaatggtaggtttagcttttatgaacagccagatgtggaaggacatacgtccatagttgatctaattgagcattcaatcagggactctgaaaatggagctttttgttattcaaggtctcggctgcctggatctgcaacttaccccgtcagactgaccaacccagtgtcccggttcatgcaggtgcgctcgttgcagtacctgtgtcgttttgttatacgtcagtataccagaatagacttaattcagaaactgcctttgccaaacaaaatgaaggattatttacaggagaagcactactgaaagattgagaaccctgcatcttgcactttgggaataagaacaagagattgaaatacagtttacaaactttcattgccatcaaaatcttttgctgccataactatttcagttttatgtgtaaaagagtcatcagtttgtttaggggtggggaagtgtcagcaaggtgtcttgggtttattttggttctttaaaaaagggaagtcttgaggttttagaggtgtgaattatgtttcatcaatgtgcagaataatcacaatgtgaattatcaaattctcctcaatgccccccccgcccagtcctttgctgctatccactgtgatttttatgcattaaaagcacatttcatgtgtattcaaccctaagtaaagttgaatgaaacttaacagaatggaaattgctatgtctttttaaatggtccattttcaaaagacagtgttgaataaacatacctgtgtgataaaacacagaatttacatatacactgaagatgagtttttaatctcttactttaaaaagatttatttagaatcgtgaattgacataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgatca

SEQ ID NO: 187578 - DNA, 7857 bp, Homo sapiens
  Payload ID: 16921
  Gene Symbol: SOCS7
  Gene Name: suppressor of cytokine signaling 7
  Uniprot ID: O14512
  ENST ID: ENST00000615473
  CDS Start-End: 1-1746
atggtgttccgcaacgtgggtcggccgccggaggaggaggacgtggaggcggccccggagccgggaccctcggaactgctgtgtccccggcaccgctgtgccctggaccccaaggccctgccgccgggcttggcgctcgagcggacctggggcccggcggctggactagaggcgcagttggcggctctggggctcgggcagccggcggggccgggggtcaagacagtcggtgggggttgctgcccgtgtccgtgtcctcctcagccgccccctccgcagccccagccgcctgctgccgccccgcaggccggggaggaccccacggaaacgagcgacgcgctgctggtcctggagggcttggaatcggaggccgagagcctggagactaacagctgctcggaagaggagctcagcagcccgggtcgcggaggaggagggggcggccggcttctgctgcagcccccaggccctgaattacctccggtgcccttcccgctgcaggacttggtccctctggggcgcctgagtagaggggagcagcagcagcagcagcagcagcaacctcccccgcccccgcctcctcccgggcccctccggccactcgcgggtccttctcggaagggctccttcaaaatccgcctcagtcgcctctttcgcaccaagagctgcaacggtggctccggcggtggggatgggaccggcaagaggccttctggagagctggctgcttcagctgcgagcctgacagacatgggaggctctgcgggccgggagctggacgcggggaggaaacccaagttgacaagaactcaaagtgccttttctccggtctccttcagccccctgttcacaggtgaaactgtgtcgcttgtggatgtggacatttctcagcggggcctgacctctccacaccctccaactccccctcctcctccgagaagaagcctcagcctcctagatgatatcagtgggacgctgcctacatctgtccttgtggctccgatggggtcttccttgcagtctttccccctacctccgcctcctccaccccatgccccagatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaagagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaacctctgatctcttatatccgaaagttctactactatgatcctcaggaagaggtatacctgtctctaaaggaagcgcagctcatttccaaacagaagcaagaggtggaaccctccacgtagcgaggggctccctgctggtcaccaccaagggcatttggttgccaagctccagctttgaagaaccaaattaagctaccatgaaaagaagaggaaaagtgagggaacaggaaggttgggattctctgtgcagagactttggttccccacgcagccctggggcttggaagaagcacatgaccgtactctgcgtggggctccacctcacacccacccctgggcatcttaggactggaggggctccttggaaaactggaagaagtctcaacactgtttctttttcagaagttttgtttttgatatttatattacttggtatggaaaactcaccttgaaggcagttggggtttgtgcccgttggattgaaagtggtgcgaagggtgagcaggtccaaagaaggggtgggaggagggaacaggggacggccattcagctggtgccaaaggcagagttagagtctgtgctgtgggcctggaagatgggaggaggggcttgaggtttgcaaaggactgggagttcctgaggaagggggaatctgcctcttgttgccatgggcagctgttgtaggagcaggagagaaaggagggtgggtggtctcgaaaagaatattgggcaaaacctagccaattggccttagctgggagaagtagtgactcctgcatccttttttaaggtttaggaacctgagttcagaaacacctctcatggaagctgtactagttgtgatttacttaattccttaagttccatgacctgaagttaaccccgttcttcctctgctctcaacccattgccccttgagataactgtacatgtcactctgatcatggtaacagcatccctattgcttctgccagctgtcatggcaatcgtgtttcccatcacctgggcggttcagagccagtcatgggctgctgaatttaatggagcatgtttccaggttcttcatggcaaactgtactcatgacttaggagtgagtgttacttccatgtgcctgtcagcttgtgagggggaatgtggaggaaggtgagaaatacagctcccacagttgtgctcttcctagaggaagctctcagaacgcagccctcacgggatttccttaggtcagaggagagcatcgcatctcacgtttttaggtttatcactgccatcccacttctgggatgggaggtagcaagggcttctgtattttcttgtgttcattctagcaacccagacatttccggatcagatcctgctggtctccactcactggaaagtctgccagatgccgatttgagagctgcctgtccctgctttcaggaggagcggggagaaaaactccaatggtctttaatggtttctgcagctggccatggccaattcatatgacattgtgagtttgctttcttatagagctgctctggggagaggtttgctattgagatgtaacagtggagctgttgggtcttcatgactcctttgcgtgtgttccatgggactctctttctgggttccccatgcttatagttgcctcgtgtcacaagacagatactaatgtcaggtttgtggcttcctgatggtttgggtggggccccagtgtcctggtaatttataggactgcctcatctgggagcattgccttcttccttagtcccacgtggagtgaccagtcttcctccttgtagctgaacagggaggaaacttgcaccattacctgactgtggaagggtggcccacaagatgagctgtgcaccataaacacagcccacctctgatttgtcatgtggtacctcttctttccttggcttccatggtagtattaccaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttcttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctgcacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccaggcagacctgagtgccgaggggttatgatggtgaggtggagcccaaagcccaaaggagtcagcaaggctcctgcccattgccagggcctcactatggtcagctcaggccatgtgagggaggcagagcctccgcaccccctgtgttactggggtttcttctggagaactcatacattcaggtacaaaacaaaccaactgaggaggtgtgacccaacctcaccacccacctttctcctcctggggagtgtcgtgttgaactgtgtctgtgtcagtgcactggtcccagccctggccgcagcctagtcctttctctgtggagtgggctgcaaaacagcagcgcaagaggagacagtcttcgtcaggtgtgggtgtttggtgcctgcatgggtggccttgcacagagcagttaggggaagatgagggggaggcatggggctgggccagctctctgggatacagcctggtcagagagtaaatggagcagaggaacaggtgtggcagcacctgcccttcacctccctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcaccccagggcccccaggaaagcatggcctgcttgaagccctctgctccctgcagaaactggggcgaggaggagctttttccttcagttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttattaaaaaaagaaaaagaaaaaaaaaagaaagaaaagtgtgcccccctcctatgctgcgatagctataaaatgattgggtcacaaaggtcaagtctgcacgtccctgtggtagaccctgctttcacattggagccttcacactcagcacaaaatgattggaggccttgataaaatggagagcaaagtcttgggagcagtgaaatgggggttggatcatagagacaggcgctggggactcgggtactgcagttaggaaagtagcgttatgagttgtactgaaaatgttgattctctaatctgccagaaaaggacctgtcttttcatgcagatttcatattgtctttgtccttttcattgcttcttgaccttcctggcaggtgtcgctcagtttcttcctgtttcccttcctgtcctctccacacctgctatcccgtcccactcccatctacctcccgggaagccagccctgcatgctgagtttgtgacctgcttcattcccatttcatttctagagggtttagaggtgacctggaaccgttccctttccctctcctaccccctcctctgcaacaccaagaggcctggaggggcagacagaaagcagccagccacggcgggaagacatgcatgtttggttgcagctggactgcgatcgtagttcctcctggagatagagtgtgaggaacttaggacactcttcctcagactctgggatcatcacataccacactgccccgctcagagtttcgtcctgagctccctaaccagctcaggtggagcagaagcctgctctcactcctccatctctggtgctcccttgggcggggacctgtccctcactcttaggcccagaacctgtccaagggacaggtagggtccaggtgccactttgggtagctggctgttggaatgcccacactggtgctgcctgtggcatagccactgctgtacgtttttggttgtttttaagaaactcgatgaagaggggtgtcattctgggctcggggtggttgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtataatttattttcataaactataaaaaaatactaaatggttaaaatagacttgcaggccaatcttaaatggggtgggaggggtctgagggtgggatggggaaagggaaagaggttttgatataaacaaaacaaatgcactttgggtgtgttttggtatttttctggggatagagggggtggggttagggatgtccctgtagattagttccagaatggggtgtctgtatatactgtattaataggcatgtttgactctcgtaaagggacgttagtagctgctgcaggtcctgtttggaaaccccatgtacaattcccagttttttgtaagtgtcagtgcgagagacatttgactcttgtgtttgtatctcctttttatgattgctgtacctacccatgtctttttggggaggggtgaaaagagatttgaaataaaaatgtttagaaatta

SEQ ID NO: 187579 - DNA, 7857 bp, Homo sapiens
  Payload ID: 16921
  Gene Symbol: SOCS7
  Gene Name: suppressor of cytokine signaling 7
  Uniprot ID: O14512
  ENST ID: ENST00000612932
  CDS Start-End: 1-1746
atggtgttccgcaacgtgggtcggccgccggaggaggaggacgtggaggcggccccggagccgggaccctcggaactgctgtgtccccggcaccgctgtgccctggaccccaaggccctgccgccgggcttggcgctcgagcggacctggggcccggcggctggactagaggcgcagttggcggctctggggctcgggcagccggcggggccgggggtcaagacagtcggtgggggttgctgcccgtgtccgtgtcctcctcagccgccccctccgcagccccagccgcctgctgccgccccgcaggccggggaggaccccacggaaacgagcgacgcgctgctggtcctggagggcttggaatcggaggccgagagcctggagactaacagctgctcggaagaggagctcagcagcccgggtcgcggaggaggagggggcggccggcttctgctgcagcccccaggccctgaattacctccggtgcccttcccgctgcaggacttggtccctctggggcgcctgagtagaggggagcagcagcagcagcagcagcagcaacctcccccgcccccgcctcctcccgggcccctccggccactcgcgggtccttctcggaagggctccttcaaaatccgcctcagtcgcctctttcgcaccaagagctgcaacggtggctccggcggtggggatgggaccggcaagaggccttctggagagctggctgcttcagctgcgagcctgacagacatgggaggctctgcgggccgggagctggacgcggggaggaaacccaagttgacaagaactcaaagtgccttttctccggtctccttcagccccctgttcacaggtgaaactgtgtcgcttgtggatgtggacatttctcagcggggcctgacctctccacaccctccaactccccctcctcctccgagaagaagcctcagcctcctagatgatatcagtgggacgctgcctacatctgtccttgtggctccgatggggtcttccttgcagtctttccccctacctccgcctcctccaccccatgccccagatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaagagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaacctctgatctcttatatccgaaagttctactactatgatcctcaggaagaggtatacctgtctctaaaggaagcgcagctcatttccaaacagaagcaagaggtggaaccctccacgtagcgaggggctccctgctggtcaccaccaagggcatttggttgccaagctccagctttgaagaaccaaattaagctaccatgaaaagaagaggaaaagtgagggaacaggaaggttgggattctctgtgcagagactttggttccccacgcagccctggggcttggaagaagcacatgaccgtactctgcgtggggctccacctcacacccacccctgggcatcttaggactggaggggctccttggaaaactggaagaagtctcaacactgtttctttttcagaagttttgtttttgatatttatattacttggtatggaaaactcaccttgaaggcagttggggtttgtgcccgttggattgaaagtggtgcgaagggtgagcaggtccaaagaaggggtgggaggagggaacaggggacggccattcagctggtgccaaaggcagagttagagtctgtgctgtgggcctggaagatgggaggaggggcttgaggtttgcaaaggactgggagttcctgaggaagggggaatctgcctcttgttgccatgggcagctgttgtaggagcaggagagaaaggagggtgggtggtctcgaaaagaatattgggcaaaacctagccaattggccttagctgggagaagtagtgactcctgcatccttttttaaggtttaggaacctgagttcagaaacacctctcatggaagctgtactagttgtgatttacttaattccttaagttccatgacctgaagttaaccccgttcttcctctgctctcaacccattgccccttgagataactgtacatgtcactctgatcatggtaacagcatccctattgcttctgccagctgtcatggcaatcgtgtttcccatcacctgggcggttcagagccagtcatgggctgctgaatttaatggagcatgtttccaggttcttcatggcaaactgtactcatgacttaggagtgagtgttacttccatgtgcctgtcagcttgtgagggggaatgtggaggaaggtgagaaatacagctcccacagttgtgctcttcctagaggaagctctcagaacgcagccctcacgggatttccttaggtcagaggagagcatcgcatctcacgtttttaggtttatcactgccatcccacttctgggatgggaggtagcaagggcttctgtattttcttgtgttcattctagcaacccagacatttccggatcagatcctgctggtctccactcactggaaagtctgccagatgccgatttgagagctgcctgtccctgctttcaggaggagcggggagaaaaactccaatggtctttaatggtttctgcagctggccatggccaattcatatgacattgtgagtttgctttcttatagagctgctctggggagaggtttgctattgagatgtaacagtggagctgttgggtcttcatgactcctttgcgtgtgttccatgggactctctttctgggttccccatgcttatagttgcctcgtgtcacaagacagatactaatgtcaggtttgtggcttcctgatggtttgggtggggccccagtgtcctggtaatttataggactgcctcatctgggagcattgccttcttccttagtcccacgtggagtgaccagtcttcctccttgtagctgaacagggaggaaacttgcaccattacctgactgtggaagggtggcccacaagatgagctgtgcaccataaacacagcccacctctgatttgtcatgtggtacctcttctttccttggcttccatggtagtattatcaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttcttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctgcacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccaggcagacctgagtgccaaggggttatgatggtgaggtggagcccaaagcccaaaggagtcagcaaggctcctgcccattgccagggcctcactatggtcagctcaggccatgtgagggaggcagagcctctgcaccccctgtgttactggggtttcttctggagaactcatacattcaggtacaaaacaaaccaactgaggaggtgtgacccaacctcaccacccacctttctcctcctggggagtgtcgtgttgaactgtgtctgtgtcagtgcactggtcccagccctggccgcagcctagtcctttctctgtggagtgggctgcaaaacagcagcgcaagaggagacagtcttcgtcaggtgtgggtgtttggtgcctgcatgggtggccttgcacagagcagttaggggaagatgagggggaggcatggggctgggccagctctctgggatacagcctggtcagagagtaaatggagcagaggagcaggtgtggcagcacctgcccttcacctccctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcaccccagggcccccaggaaagcatggcctgcttgaagccctctgctccctgcagaaactggggcgaggaggagctttttccttcagttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttattaaaaaaagaaaaagaaaaaaaaaagaaagaaaagtgtgcccccctcctatgctgcgatagctataaaatgattgggtcacaaaggtcaagtctgcacgtccctgtggtagaccctgctttcacattggagccttcacactcagcacaaaatgattggaggccttgataaaatggagagcaaagtcttgggagcagtgaaatgggggttggatcatagagacaggcgctggggactcgggtactgcagttaggaaagtagcgttatgagttgtactgaaaatgttgattctctaatctgccagaaaaggacctgtcttttcatgcagatttcatattgtctttgtccttttcattgcttcttgaccttcctggcaggtgtcgctcagtttcttcctgtttcccttcctgtcctctccacacctgctatcccgtcccactcccatctacctcccgggaagccagccctgcatgctgagtttgtgacctgcttcattcccatttcatttctagagggtttagaggtgacctggaaccgttccctttccctctcctaccccctcctctgcaacaccaagaggcctggaggggcagacagaaagcagccagccacggcgggaagacatgcatgtttggttgcagctggactgcgatcgtagttcctcctggagatagagtgtgaggaacttaggacactcttcctcagactctgggatcatcacataccacactgccccgctcagagtttcgtcctgagctccctaaccagctcaggtggagcagaagcctgctctcactcctccatctctggtgctcccttgggcggggacctgtccctcactcttaggcccagaacctgtccaagggacaggtagggtccaggtgccactttgggtagctggctgttggaatgcccacactggtgctgcctgtggcatagccactgctgtacgtttttggttgtttttaagaaactcgatgaagaggggtgtcattctgggctcggggtggttgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtataatttattttcataaactataaaaaaatactaaatggttaaaatagacttgcaggccaatcttaaatggggtgggaggggtctgagggtgggatggggaaagggaaagaggttttgatataaacaaaacaaatgcactttgggtgtgttttggtatttttctggggatagagggggtggggttagggatgtccctgtagattagttccagaatggggtgtctgtatatactgtattaataggcatgtttgactctcgtaaagggacgttagtagctgctgcaggtcctgtttggaaaccccatgtacaattcccagttttttgtaagtgtcagtgcgagagacatttgactcttgtgtttgtatctcctttttatgattgctgtacctacccatgtctttttggggaggggtgaaaagagatttgaaataaaaatgtttagaaatta

SEQ ID NO: 187580 - DNA, 480 bp, Homo sapiens
  Payload ID: 16921
  Gene Symbol: SOCS7
  Gene Name: suppressor of cytokine signaling 7
  ENST ID: ENST00000617765
  CDS Start-End: 1-480
cggcaagaggccttctggagagctggctgcttcagctgcgagcctgacagacatgggaggctctgcgggccgggagctggacgcggggaggaaacccaagttgacaagaactcaaagtgccttttctccggtctccttcagccccctgttcacagatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcc

SEQ ID NO: 187581 - DNA, 1827 bp, Homo sapiens
  Payload ID: 16921
  Gene Symbol: SOCS7
  Gene Name: suppressor of cytokine signaling 7
  ENST ID: ENST00000613678
  CDS Start-End: 18-1661
cccggccgccgcagctgatggtgttccgcaacgtgggtcggccgccggaggaggaggacgtggaggcggccccggagccgggaccctcggaactgctgtgtccccggcaccgctgtgccctggaccccaaggccctgccgccgggcttggcgctcgagcggacctggggcccggcggctggactagaggcgcagttggcggctctggggctcgggcagccggcggggccgggggtcaagacagtcggtgggggttgctgcccgtgtccgtgtcctcctcagccgccccctccgcagccccagccgcctgctgccgccccgcaggccggggaggaccccacggaaacgagcgacgcgctgctggtcctggagggcttggaatcggaggccgagagcctggagactaacagctgctcggaagaggagctcagcagcccgggtcgcggaggaggagggggcggccggcttctgctgcagcccccaggccctgaattacctccggtgcccttcccgctgcaggacttggtccctctggggcgcctgagtagaggggagcagcagcagcagcagcagcagcaacctcccccgcccccgcctcctcccgggcccctccggccactcgcgggtccttctcggaagggctccttcaaaatccgcctcagtcgcctctttcgcaccaagagctgcaacggtggctccggcggtggggatgggaccggcaagaggccttctggagagctggctgcttcagctgcgagcctgacagacatgggaggctctgcgggccgggagctggacgcggggaggaaacccaagttgacaagaactcaaagtgccttttctccggtctccttcagccccctgttcacaggtgaaactgtgtcgcttgtggatgtggacatttctcagcggggcctgacctctccacaccctccaactccccctcctcctccgagaagaagcctcagcctcctagatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaagagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaacctctgatctcttatatccgaaagttctactactatgatcctcaggaagaggtatacctgtctctaaaggaagcgcagctcatttccaaacagaagcaagaggtggaaccctccacgtagcgaggggctccctgctggtcaccaccaagggcatttggttgccaagctccagctttgaagaaccaaattaagctaccatgaaaagaagaggaaaagtgagggaacaggaaggttgggattctctgtgcagagactttggttccccacgcagccctggggcttggaa

SEQ ID NO: 187582 - DNA, 480 bp, Homo sapiens; identical to SEQ ID NO: 187580
  Payload ID: 16921
  Gene Symbol: SOCS7
  Gene Name: suppressor of cytokine signaling 7
  ENST ID: ENST00000632687
  CDS Start-End: 1-480

SEQ ID NO: 187583 - DNA, 1827 bp, Homo sapiens; identical to SEQ ID NO: 187581
  Payload ID: 16921
  Gene Symbol: SOCS7
  Gene Name: suppressor of cytokine signaling 7
  ENST ID: ENST00000631692
  CDS Start-End: 18-1661

SEQ ID NO: 187584 - DNA, 1839 bp, Homo sapiens
  Payload ID: 16922
  Gene Symbol: SUFU
  Gene Name: suppressor of fused homolog (Drosophila)
  Uniprot ID: Q9UMX1
  ENST ID: ENST00000369899
  CDS Start-End: 147-1448
cgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaactctgaacctatcctcggagctctgccctcccgtcctggaacgtctttctgccctgaggagagggtagtcagcatctccaattttcagcagctcaagaaccttggcccccacaggacttcgcagatgtcacattgcccctcagtcccctgaatgcccttcggacccaaccccaattccccaagcccctgaccccctagctgccggggttcccactcccagtgccacaaccccctcacctccctggcagcccctcagcgagcctgaggcccagcacccgctggctccccagcacatggtcccctcccatgggctgttgcccagggaaccggggcgcggtgggaacgagctgctggcctcggcatgtttcaataaagttgctgtgctgggagctactca

SEQ ID NO: 187585 - DNA, 5001 bp, Homo sapiens
  Payload ID: 16922
  Gene Symbol: SUFU
  Gene Name: suppressor of fused homolog (Drosophila)
  Uniprot ID: Q9UMX1
  ENST ID: ENST00000369902
  CDS Start-End: 167-1621
gacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcagtggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctggtggagcccggggcagggggagagtagagacactcccttgtgcagctttgagcctagtttagctggggccagggaggggtgctactgttttccaagtgaatgggtctcaaagacttggtgaccccagcctcatcttctaggccttttccacccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactgctctctgctgccctcccatcctccctgtatccattcatgccctatctttcattctccactcctaatccctctcctttctggcatcctggcctctcgtggtcctcagcccctcacccccagtactgcagatctcacagtttgccttccagaagccagcctatctctagcccatggttttggagttcctctcgggttatctcccacgcctgacctggaaccagcaagcccctttcctgccttcttacccccaactctagggatgggactgttacaatacttcaagatcactctttacacctcttcaaagcaaagtcatgacaatgcagggctcctcattgctcccatctgcctctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcagaagtgcctgggttgtgtgctcatttctggctgcctgaagtagtggagccggaagcccggggccctggcagagggagtgggttg

SEQ ID NO: 187586 - DNA, 2601 bp, Homo sapiens
  Payload ID: 16922
  Gene Symbol: SUFU
  Gene Name: suppressor of fused homolog (Drosophila)
  Uniprot ID: Q9UMX1
  ENST ID: ENST00000423559
  CDS Start-End: 75-1520
gcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaagtgagaaggccctttttcttctccctccttcctttcatagacttccttgcccacccctcctcttctcccttggcagctcttgatggcaccccttcctggggggctggtcatgaatgcctcatggattcagggcctggggcctgtgtgtaggtatggagtgtggatgctgctacccactccagcagcttaggagcacttcctgaccttctccccctgtcacctgagacacaagtgttaactctccaggccctggctcttggtaattctggttccccgtggaaatccaggttggagggatataagactttctgcaccttgggtaaaccaaggtacaagaactcaaggatgaagcaagatgggaggatgtgtggaggccactctccaatggctacatggaaatcccaccagaattcagacagtggcatgtgtgcctggaccagggctgggcaggcctcagtgggaagagcctccccttcttagcctacccccatctgacagccctcccgttcctcctgagtttgtgtgaccagagacctgctggcttatccggagcactttgtccttcctttgctcttctggctggagcgagcttcagagctgttgccaagcagggtaccagggcctcagagccataggcctccttccagtccccaccccgtcccgggtctctaacaggtgctcaacctactccaccacactcccgagtgtcttggagggacagcatccttttttggcatttgtttgttgcgggtggggagaggattgaacccttaacctcacctcgctcgcaagtatcaagaaagggaacctgaccctaaacctaaaggtggccatacctggtttgtgaatgtattggagaggcatgcagcattacagtagaggggaagagaatgatgctaggtttgtgagtttcacccagtctggggagtctgtgaagcatatgtagtcaatacagacacactttttgtccctgcatgtctacagaatttctcctccttcaggccaggcccctcttctcccgccaccaccaaaatacaacccttaattaaaacaaacagcaaacaaaggacaccaaccacactccccagactaagccgagatagaaatggaagctagtgctttagggatattgtgttccataaattatcttgcctttttccactgttgttattatatcgtttcataacaaaattactttgaaccataaagttataaatacattttaaaagtc

SEQ ID NO: 187587 - DNA, 14371 bp, Homo sapiens
  Payload ID: 16923
  Gene Symbol: SOGA1
  Gene Name: suppressor of glucose, autophagy associated 1
  Uniprot ID: O94964
  ENST ID: ENST00000237536
  CDS Start-End: 343-5328
cgggccgcagccggactcggagcccgagggagcgatcggcgtgcgggcggcgggggcccgggcgcgctccgggggcgcggcgaggccgagggggcgggcgccgggcggagccgcagccggagccggggcgcctggaggcggtcgggccgcactctccgagcccagagcagcggagagaccgcgcggcggggcttgggacggggacgcggtgtcggggccgaggtgggccgagagcagccgcagccccagcggccggagccgcgccgggtccctccccagggacgtcgaggccgggcgggcctgggccatgcgcgcagctcgctgaggccgagggaggccgcgatggaggcgccggcggccgagcccccggtccggggctgcggtccccagcccgcgcctgcacccgcgcctgccccggagaggaaaaagagccaccgcgcgccgtcgccggcccggcccaaagacgtggccggctggtcgctggctaagggccgccgcggcccaggcccgggctcagcagtcgcctgcagcgccgcgttctcctcacggccggacaagaaggggcgcgcagtggctcccggggcgcgcggtgcgggtgtgcgggtggccggggtccgcaccggggtccgtgccaagggccgtccgcgctcgggtgcggggccgcgaccgccaccgccgccccccagcctcacggatagcagctcggaggtgtcggactgcgcgtcggaggaggcgcgcctgctgggcctggagctggcgctgagcagcgacgccgagtccgcggccgggggcccggcgggggtccgtacggggcagccggcccagcccgcgccctccgcgcagcagcccccgcggccgcccgcctccccggacgagccgtcggtggccgcgtcgtcggtgggcagcagccgcttgccgctcagcgcctcgcttgccttctccgacctcaccgaggagatgctggactgcgggcccagcggcttggtgcgggagctggaggagctgcgctcggagaacgactatctcaaggacgagattgaggagctgcgggccgagatgctggagatgcgggacgtctatatggaggaggacgtgtatcagctgcaggagctgcgacagcagctggaccaggccagcaagacctgccgcatcctgcagtaccggctgcgcaaagccgagcgccgcagtctccgtgccgcccagaccggccaggtggacggcgagcttatccgtggtctggagcaggatgtcaaggtctctaaggacatctccatgcggctgcataaggagctcgaggtggtggagaagaaacgggcgcggctggaggaggagaacgaagagcttcgtcagcggctcatcgagactgagctggctaagcaggtgctgcagacggagctggagcgaccgagagagcattccttgaagaaaagaggaacccgctccctggggaaggccgataagaagactttggtgcaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccagctgcagaaggctgccgacccctgggtcctgaagcactcggagctggagaagcaggacaacagctggaaggagacacgcagtgagaagatccacgacaaggaggctgtttccgaagttgagcttggaggaaatggtttaaagagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggagaggaaagtgaagagcacatccagccagacggtgggcctggccagtgtgggcacacagaccatccgcacggtcagcgtgggcctgcagaccgacccaccccgcagcagcctccatggcaaggcctggtcaccccgcagctcttcgctcgtgtctgtgcgcagcaagcagatctcctcctccctggacaaggtccattcgcgcatcgagcggccctgctgctcccccaagtatggctcaccaaagctccagaggcggtctgtgtccaagctggacagcagcaaggaccgcagcctgtggaacctgcaccagggcaagcagaacggctcggcctgggcccgctccaccaccacgcgggacagccctgtattgagaaacatcaacgatggactctccagcctcttcagtgtggtggagcactcagggagcacggagtctgtctggaaactaggcatgtctgagacgcgggccaagcccgagcctcccaagtacggcattgtgcaggaattcttccgtaatgtgtgtggccgggcaccgagccccacctcatcagcaggagaggagggcaccaagaagccagagcccctctccccagccagctaccatcagccagagggtgtggccaggatcctgaacaagaaggcagccaagttgggcagcagtgaggaggtcagactcaccatgctcccccaggtggggaaggatggtgtcctccgggacggagatggagccgtggtccttcccaatgaggacgctgtttgtgactgtagtacccagtctctcacctcctgcttcgcccgatcgtcccgctctgccatccgccactctccttccaagtgcaggctgcacccttcagagtccagctggggtggggaggagagggcactcccccccagcgagtgacagagcagccaagctccccgcctcaaccagcccagcccctggatagcagaagggaaccagcagagacgagacgaggtgaggcgaggggctgtgtcctcagcattgcctggccctggagggacagcagtgatgccactgccagaatgcagctttcacatcaaggtaaagccgggtctcctgctggcccctgggtggtgagcttcgacttcccaggggaaggcagtgagtgggagagagaccaaacctgggcttcccaagcatccactgagagatctgtcaagagccgatccctgggtcctaagagagagccttgcctggttctgcccatgccaccctcttggaagagcccaagaaggatacatgtctggccatgcctttggggaaaaggagtcggagagatgtttcctgctgaccatccaccccttcatttgggaggagacactgctgagaagaacaggctttgctctagggctccatgtttggttcctggtggagccctgttgggcatcatcaccatcacctccttctctccaccacctcctcctcccagccccactgctctagattgctgggacactagggagtatgatagggcagtagccagggccattgcttagtgtcctggagccctggatctccctgcccatagcctggatgcagcaagagctgggaggcgaagtggaaacatgcagggctcagggttggggagtgattgcaattgccttccttgccaaagtgacttggggccccaacgttcccagcagaccccttgaggacagaaataggtagagtcagtctcaagacctggtgcatagataaatgcctaaatacactgccttgatctcaagtgatctcagaggcctctttccctggcaccctgagaggcagcaggcactacatctccactgtgtttacatcctgcagctggtcggggggcaaagatattcccagtaagagattcttggttggccaggtcaggcccaggagaacaccaagaggccagagcccaggacacagcagtagactggggcctggaaacacgtatcttgcctagattgtttatttgaatttttcctactataaatatttaaggtggtttactttattttaataatttaatttaccccaaagtccctaaggtaatttattggaggttgaaacatgcattcttgccactgggacaacatgaggcctctaacagcacgggcaggcatggggtcccctgggtggacgaggccgcttggcagccaggtttggagacctggcctcctggtcagctttggagggcccctcaacagagctggagccctgcaccccaacacggctggccatgtggcctcagaacactacttattactcaatgcctggtacttggccagccccagcggtcagtctataaatactcactgacaaggtggagggctggacggccatcaccactccccagacgttctccattgcctgtctcatttccctccctccctctgacacctttcttcatgagtcgaacgtggattactaaagctctattaagagtgtggagatccctccaagtttcccaaatgagaactcacaggaaaacaggactgaactttgagaatgttgtttatcgcagctttgcacataaacctgagtgtctcccagcctgcctcggttctcaccagcctgccagccttttcaccagcctctctccttagccttatggcctttcacggctcttctccctgccccagctctgctgcccgcccttcctcacgtcccctgtgagctgcctgagccattggttggatttcgatgtggctcattgcagcatgtggggcagcgcctcccatggcctcgccttggtgccggtgaaccccttttggttgcacacatgctccccacacacacatagacatcagccttcctgtaactgactggggacccagagtggaaacaccaggatggatcagcttgtctgcagaattgcccatcaggaagaccaaaagccagtagctttgctgatctgcccccaggactctggaggcgcccctgcactcccacctcccacctgccagttcccagacccacccattcgggatcacctggaccagttaccccaagtcctgcatctcccttccctgcaggctgaacaccagggtcatgccagtcccgccagccgcctcctccatgccccagtgactggtgtgggcagagcaggcagccagtggagctgtgggccagttccgctcttggatgctgctgctctcacccatgaggtcaggggggccctccaaggttatctccaggtgaggggattcacatcaggccacaagccaccagaggccttctgccacctcccagagcgacagccagggaggctgcgtactcagcctcggggagaaatccccgtgggacctgagccccaagacctacggaccactcagccttaccatcgtaccgtccaggattgtccttgccatctttgttgtctcagccagaccttggttttcagtaaagccccagtttctacttcctgcatgccactgtgcaaggccactcatcactgttcctgcagaagcctctggacgtggggctggatggggttgaaaatgttacatgtaaatattggtttggttcggtttttagcattttacttggtaactggttgttttcttttttggggtggggggattggtttgtaaaaattctctactcttttggaatgtgatttctaagtttgttggtttcttcaaatgccttttaagtcttggtaacattcccaaagcagaaaactgcctgacccacagtggggattccctggagaattggggtcccaagaaggaatgctgcccttctcgaacccgttctcccccttcctcctgcctctctgccttttactgctattcccttcttctcctcctttatccttctttctgttttccccatctccactctctcttcaaccaaagtcccaaggaaccctcggggctcaatcccccatagaccacttggcttgggtccatggggttggcatcagttggttggcggaaatgggggaccagttggcatgatggccctaaactgggaaacctcatgtttcttatgtctcacctctttccagagccaaatcagccccttttggaatgatgacttcattggaatgcaaatcaagtcattttggtgcatcagtggctcttaggcctgcacacacgagacatcagaatccaatcctctgaccctgtgccagccctttcccccagtttatttcccaccaaaggctgacctctaagaggtcttgctttctatgaactcaagatgggtcccacctctaggtgtccccaggtgcactcttctaccggttggcttccgatgtgacaaggccaagggcccaaagacttgaccctcttacacccttgctgacatggttccatcatgtccacccgcatgcacttttatggtttcatcacccagcctcttctcctctggcccacccagcgtccaggctctttctccctctcccctcctatctagaatgtcccctgcttctagcctcaccagaccccccaagctcccactacttcttccataataatagtaataacaatggttatcatcatcccctgcacatcccgcctaaagcactttactatatagaaaacgtttcccctggccgggcatggtggctcacgcctgaaatcccagctctttgggaggctgaggcgagcggatcagttgaggtcaggagttcaacgccagcctggccaacgtggtgaatccctgtctgtactaaaagtacaaaaaattagctgagcatggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccaccccacatctccttcagacctctcagggacaactctgggaggcagccttggcaggacatgggttagtgcgcccattttgctgtgaggaaactgaggtacaggtctcatcccagagcatgagaagtcactgagtttagatgagaacttgggtccaactctgtcctgtttgctgtgcaaatccgctgccctgctgggggcttttggtgggtccagaatacccagaatatgctgctggccaacccaggcataaaacaagtccattctagatcactgagccttgtgtattccagagggtgatctgaggtccccattcagcagaattctctgagggcatgttcagaatgtagattcctgggccccaccttgaatttgcatgtttaacaaactctcctggggttgaggggtgggtgcagtggtcacacctgtaatcccagcactttgggaggctgaggcgggtggatcacttgagctcaggagttcgagcctggccaatatggtgaaaccctgtctctactaaaaatgcaaaaattagccaggtgtggtggcacatgcctgtaatcccagctacttgggaggctgaggcaggagaatcacttgaacctggtggggagcagcggttgcagtgagccgagattgtgccattgcgctctagcctgggcaacggaatgagacttgtctcaaaaaaaataaaaaataaaaccagccctccccgggggatcttaggcactattggccacaccattggtgttcgtggccctgattattaggctatctttctttttttaagtttttttagatttattttttattttatttatttatttatttattatttattattattatttttagagacagggggtctccctatgttgcccaggctggtttcaaactcctgggctcaagtgatctgccctcctcagcctcccaaagtgctggggttacaggcaggcatcagccaccgtgccaggtcatcttcctttttcttttttttttggagacagagtcttgctctgtcattcaggctggagtacagtggcgccatttcagctcaccgcagcctccacctcccaggttcaagcagttctcctgcctcaacctcccgagtaactgggattacaggtgtgtgccaccacacccgactaatttttttatttttagtagagacggggtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggattttcaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttctaagtgtctcgaagtacatttgcaatgtgtaactgccacctccagaactttttcatcatcctaaactgaaactctgtacccactaaacagtaactccccactccccctgtccccagtccctggtaacctctattctactttttttttttctctgtggattggcctattctaggtatctcttttaagtagaatcatatagtatttgtccttttgtgtccagccccctcattttttgagatgaggaatcaggcccagagaaggcagtggctcacccaaggtcacatcgcaaaccagaggcagagccaagaccagaacccaggtttcctgactcctaacaggtcttgcatccccagtagtgaatgagacactgctttgactttctgtaatcttggtttagccccttcctttctctgggctcagtctgcttcccaccactcacccattctttctttatcatctccctccaaagcctcttgtcctcctgcctcctcttctccttggctggttcctgccagcaaatggagtggccctggtccatgccaggttttcctcttctgggtccggagctcactatagtattcagccctcagtcctcccaggatgttcttcccagcactgctgcctcgtgcggattttcccgtaacctcagtaactggcttcttgtccccctgcttcctaccagggaagccttcctgtccgcgtctgtggtttcccaactctgatatttgctctcaaatgtggtggtgtcctggttctgtgtttatttattttgtgttttctcacacacacaaaaaaaagcctcttcctccaatgcatcaggaggcaccagccctgccagcccttctcactgggctcaccctgccccagcaaccccccggtgccacccttaagccacactgtcttctctgtaagcagcctgccagcagcagccccagcactttgcaatgggcgtgtgtgtggtggtgggtggggggggcttggatccctcctttttcctcccctgccctgcccaggcccagatggccttgactgtaaagcaggtgctgcctgacaggttcttctctccctgtctctggtcattgatccatctctttgtccattcagtatccaaccatcctctccattctcctctggacctcaccactctcagagctgcttgtcctggcagaatctacagttcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatgaacagct

SEQ ID NO: 187588 - DNA, 3703 bp, Homo sapiens
  Payload ID: 16923
  Gene Symbol: SOGA1
  Gene Name: suppressor of glucose, autophagy associated 1
  ENST ID: ENST00000279034
  CDS Start-End: 328-3378
gatgtgttttctgcctttctggactactttgcctctaagatgcagaaactgagtacaagggaaaggactccaaatccccagtatgtcccctgcaggagcagagttgaaggaggtcccaccaggtctggtgggtggccctgctcaggcttacctcccccttgtaggggtcactgggaactgtcaactgcgaaggactgtgatctccagtctggtatggtctgctctggggtccaagtgaggaaagcataaatcgggcaactctctcccagtgagaagatagaaggagcttctacagagaaggacgagattgaggagctgcgggccgagatgctggagatgcgggacgtctatatggaggaggacgtgtatcagctgcaggagctgcgacagcagctggaccaggccagcaagacctgccgcatcctgcagtaccggctgcgcaaagccgagcgccgcagtctccgtgccgcccagaccggccaggtggacggcgagcttatccgtggtctggagcaggatgtcaaggtctctaaggacatctccatgcggctgcataaggagctcgaggtggtggagaagaaacgggcgcggctggaggaggagaacgaagagcttcgtcagcggctcatcgagactgagctggctaagcaggtgctgcagacggagctggagcgaccgagagagcattccttgaagaaaagaggaacccgctccctggggaaggccgataagaagactttggtgcaggaggacagtgcagacctgaagtgccagttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccagctgcagaaggctgccgacccctgggtcctgaagcactcggagctggagaagcaggacaacagctggaaggagacacgcagtgagaagatccacgacaaggaggctgtttccgaagttgagcttggaggaaatggtttaaagagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatg

SEQ ID NO: 187589 - DNA, 4478 bp, Homo sapiens
  Payload ID: 16923
  Gene Symbol: SOGA1
  Gene Name: suppressor of glucose, autophagy associated 1
  ENST ID: ENST00000465671
  CDS Start-End: 1-3826
gttgcactttgcaaaggaggagtcagccctcatgtgcaagaagctcactaagcttgccaaggagaatgacagcatgaaggaggagctgctgaagtaccgctcgctctatggggacctggacagcgcgctgtcagccgaggagctggccgatgccccccactcgcgggagaccgagctgaaggtgcacctgaagctggtggaggaggaagccaacctgctgagccgccgcatcgtggagctggaggtggagaaccgaggcctgcgggctgagatggacgacatgaaggatcatggaggtggctgtgggggtcctgaggcacgcctggccttctccgcgctgggtggcggagagtgcggggagagcttggcagagctgcggcgacacctgcagtttgtcgaagaggaggccgagctgctgcggcgctcctctgccgagctcgaggaccagaacaagctgctgctgaacgagctggccaagttccgctcggagcacgagctggacgtggcgctgtcggaggacagttgttctgtgctcagcgaaccttcacaggaggagctggcggccgccaagctgcagatcggcgagctcagcggcaaggtcaagaagctgcagtacgagaaccgcgtgctcctctccaacctccagcgctgtgacctcgcctcctgccagagtacgcggcccatgctggagacggacgccgaggccggggactctgcccagtgtgtgcctgctcccctgggcgagacacacgagtcccatgcggtccgactctgcagagccagggaggccgaggtgctgcctgggctgagagagcaggccgccctggtcagtaaggccatcgatgtcctggtggctgatgccaatggcttcacggctggcctccggctgtgtctggacaacgagtgtgctgacttccggctgcatgaggcccccgacaacagcgagggccccagggacaccaagctcatccatgccatcctggtgcgcctgagcgtgctgcagcaggagctgaatgccttcacgcggaaggcagatgcagtcctcgggtgctctgtcaaggaacagcaggagtccttctcatcactgccccccttgggctcccaggggctctctaaggagattcttctggcaaaagaccttggctcagactttcagccacctgacttcagggacctgccggaatgggagcccaggatccgagaggctttccgcactggtgacttggactctaagcccgaccccagccggagcttcaggccttaccgagctgaagacaatgattcctatgcctctgagatcaaggagctgcagctggtgctggctgaggcccacgacagcctccggggcttgcaagagcagctctcccaggagcggcagctacgaaaggaggaggccgacaatttcaaccagaaaatggtccagctgaaggaggaccagcagagggcgctcctgaggcgggagtttgagctgcagagtctgagcctccagcggaggctggagcagaaattctggagccaggagaagaacatgctggtgcaggagtcccagcaattcaagcacaacttcctgctgctcttcatgaagctcaggtggttcctcaagcgctggcggcagggcaaggttttgcccagcgaaggggatgacttcctcgaggtgaacagcatgaaggagctgtacttgctgatggaggaagaggagataaacgctcagcattctgataacaaggcctgcacgggggacagctggacccagaacacgcccaatgagtacatcaagacactggccgacatgaaggtgacgctgaaggagctgtgctggctgctccgggatgaacgccgtggtctgacggagcttcagcaacagtttgccaaggccaaggctacctgggagacagagcgggcagagctcaagggccatacctcccagatggagctgaagacagggaagggggccggggagcgggcagggcccgactggaaggcagccctacagcgggagcgtgaggagcagcagcacctcctagctgagtcctacagcgctgtcatggagctgactcggcagctgcagatcagtgagcgcaactggagccaggaaaagctgcagctggtggagcggctgcagggtgagaagcagcaggtggagcagcaggtgaaggagctgcagaaccgcctaagccagctgcagaaggctgccgacccctgggtcctgaagcactcggagctggagaagcaggacaacagctggaaggagacacgcagtgagaagatccacgacaaggaggctgtttccgaagttgagcttggaggaaatggtttaaagagaaccaaatctgtttcttccatgtctgagtttgaaagtttgctcgactgttccccttaccttgctggcggagatgcccggggcaagaagctgcctaacaaccctgcctttggctttgtgagctccgagccaggggatccagagaaagacaccaaggagaagcctgggctctcgtcgagggactgcaaccacctgggtgccctggcctgccaggaccccccagggaggcagatgcagcgcagctacacggctcctgacaagacgggcatccgagtctactatagtcccccggtggcccggcgcctcggagtccctgtggttcatgacaaagagggcaagatcattatcgagcccggcttcctcttcaccacagccaagcccaaagagtcggccgaggctgatgggctggctgagagctcctatggtcggtggctctgcaacttctcacggcagcgcctggacggaggctcagcgggcagcccctcggcggccgggcctggcttcccagcggccctgcatgactttgagatgtcaggcaacatgagtgatgacatgaaggagatcaccaactgtgtgcgccaggccatgcgctccggctcactggagaggaaagtgaagagcacatccagccagacggtgggcctggccagtgtgggcacacagaccatccgcacggtcagcgtgggcctgcagaccgacccaccccgcagcagcctccatggcaaggcctggtcaccccgcagctcttcgctcgtgtctgtgcgcagcaagcagatctcctcctccctggacaaggtccattcgcgcatcgagcggccctgctgctcccccaagtatggctcaccaaagctccagaggcggtctgtgtccaagctggacagcagcaaggaccgcagcctgtggaacctgcaccagggcaagcagaacggctcggcctgggcccgctccaccaccacgcgggacagccctgtattgagaaacatcaacgatggactctccagcctcttcagtgtggtggagcactcagggagcacggagtctgtctggaaactaggcatgtctgagacgcgggccaagcccgagcctcccaagtacggcattgtgcaggaattcttccgtaatgtgtgtggccgggcaccgagccccacctcatcagcaggagaggagggcaccaagaagccagagcccctctccccagccagctaccatcagccagagggtgtggccaggatcctgaacaagaaggcagccaagttgggcagcagtgaggaggtcagactcaccatgctcccccaggtggggaaggatggtgtcctccgggacggagatggagccgtggtccttcccaatgaggacgctgtttgtgactgtagtacccagtctctcacctcctgcttcgcccgatcgtcccgctctgccatccgccactctccttccaagtgcaggctgcacccttcagagtccagctggggtggggaggagagggcactcccccccagcgagtgacagagcagccaagctccccgcctcaaccagcccagcccctggatagcagaagggaaccagcagagacgagacgaggctgaacaccagggtcatgccagtcccgccagccgcctcctccatgccccagtgactggtgtgggcagagcaggcagccagtggagctgtgggccagttccgctcttggatgctgctgctctcacccatgaggtcaggggggccctccaaggttatctccaggtgaggggattcacatcaggccacaagccaccagaggccttctgccacctcccagagcgacagccagggaggctgcgtactcagcctcggggagaaatccccgtgggacctgagccccaagacctacggaccactcagccttaccatcgtaccgtccaggattgtccttgccatctttgttgtctcagccagaccttggttttcagtaaagccccagtttctacttcctgcatgccactgtgcaaggccactcatcactgttcctgcagaagcctctggacgtggggctggatggggttgaaaatgttacatgtaaatattggtttggttcggtttttagcattttacttggtaactggttgttttcttttttggggtggggggattggtttgtaaaaattctctactcttttgg

SEQ ID NO: 187590 - DNA, 2190 bp, Homo sapiens
  Payload ID: 16924
  Gene Symbol: SIKE1
  Gene Name: suppressor of IKBKE 1
  Uniprot ID: Q9BRV8
  ENST ID: ENST00000060969
  CDS Start-End: 71-694
gacagactcccagaagatctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccagtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaaca

SEQ ID NO: 187591 - DNA, 5506 bp, Homo sapiens
  Payload ID: 16924
  Gene Symbol: SIKE1
  Gene Name: suppressor of IKBKE 1
  Uniprot ID: Q9BRV8
  ENST ID: ENST00000369528
  CDS Start-End: 79-714
aatgctgagacagactcccagaagatctgagcgagtcgcgtagctgagcccggcaggggctggggtggtgctgctgctatgagctgcaccatcgagaagatcctgacagacgccaagacgctgctggagaggctacgggagcacgatgcggccgccgagtcgctggtggatcagtcggcggcgctgcaccggcgggtagcagctatgcgggaggcggggacagcgcttccggaccaggtcaggcagaggtatcaagaggatgcatccgatatgaaggacatgtccaaatacaaacctcacattctgctgtcccaagagaacacacagattagagacttgcaacaggaaaacagagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagaaattgagagtcagattgacagaatctgtgaaatgggagaagtgatgaggaaagcagttcaggtggatgatgaccagttttgtaagattcaggaaaaattagcccaattagagcttgaaaataaggaacttcgagaattattgtccatcagcagtgagtctcttcaagccagaaaggaaaactcaatggacactgcttcccaagccatcaaataactgaactctgaatgatggctggagattgtctatcaaggaaggaagttactgtcttcccattcaagtactgtccattaagtgtcttgcctcagatttgatttaatcttaattaaaggtatcaggtggcaatttagaattccagtcaatattggctgtccacagttctcagatgtgttaatgtgaatactacatgctgaatttcaccattcctttctcaaagagactacttttaattttcatttctgggaccttgatttatataaactatgttttcagttctttgttatttttcacatctctgaaactttgagcattttttataagccagcaatttattttacatagcattgtaaaatacacttctaggaaattttaggaaagatttaactgtttaaatctatttggcataaaccttgattttttttttccatttgacaaaaataatacaattccacagaactagatcagcagattctctgatttgtaatgtcattcacctgtgacattttaagtctctctggtgctaagaattggcactttatagcctggtgcctttacttttaatttgagagaacctactgctagtcccaggaaacacacttggaaataagtcagctattttttttgcccagtgatgctatagttgtcatattgtccaaagttcatattgttcaaagctgaggagcttgtcctgtgtatgtgaatgcacacatgtgcacttagttcaaatactaaaagtagcttttattaaatataatcagccaaaaacacacacaaaataaaaaaaacaaatataagtagtcagtttttcaatgttatcctactagttctacattctattttaatttttatacaatttccattttatagttaagaaccatcacttacttggattggatgtctttcattcctagcactaatagttggctttctttttttttgtttacatagaagcagggtttttttttatcttttttctttttttttgtttaagctatataaaaaggtgaggaagcagttttgttacctaatgaaaattattacactcataatgctgtgtaggcaacattgagattcaaatgcccagtggtcaactgggttcactcatcaactcattcccgtcccagtttactcacatttcaaatttataaatttcttcatgttatactattctatttagatttgcccagaattagttgaaataatgctaaacctgtcaatattttccagtaacattaagcaccatactgcatgggagagacacagtactaaaaagagttgttagtgctttatgtgagtgatatttctttcgtaatgctataaagaactacagttaaaataacaaaatattttaaagatgtcctaaaagcatctgatcccagtaataactaatggatgtcatctagagcagtgggtgttaatgaataggtatatgtcatttaagaatttttcaaatttctgtttgatatcctgcatagaatttgacaaaaaaaacacttccaagtgtgagcattttttatttcatttcccaagagtaagtaagtaactattagcccagccatctgcctcgaagtataccttaagtgaccccataaatccattcaagaggcaggtactctataccatttggcagccacggccaaacctaccatggccagatttcagtgaaaatgatgaagtaatcaaatcaaggtataatatggtgtccctttatgtgctttatgttcctttagagctgtttataaagttctttatatctcaagtgttaggataaatcgacatactaacttttccccctgcaaaattaaaagcctgaggtacaagtctaagaagcttttagtgctctacataatataaattctggctggtgttaatgctatgaagataatatgtagttagaaaattgagtcggggaggaatgctcttcattttaagtggattttaaagtttctccttgagtggatgaagaacttgcctggtttgcaaaaatcttagttcaaaattatattttctaacaaaaactgcattttgagaagataagctaattttactcagtagtaagtcaaatgaggaagtgcagagggtttttttacatatatatagcaaccttgtcaagtggtcctcacaagagtcataaatactttgtaattagcacagtatattcagcagtgtataactctacaaatagtaccttatattagtgtagtattatatcaatatcttatgtataattcttatattaataccttatgcataattggattcaaacattgaaggtctattttagtgttcttcaaaatgtgcttccctgacctactgaaatagaaacttggtgatgaagttcaagaatttgtattctaatcatctcaaacaattcctaaagacactgattttaaaatatctagtctaggccccattgtgtaatagttagcactctaaaagatgaaaaagaaaatagtctatgtgccaaccacttcattagtacttatgaatttaaaaatgaaaaagtctggtacaggagacaagtatatatataaaattataatgcagtgtgataaatccattatagtatgtataagatacagaagagggactttaaacttgagaattcaatagagataataaatgggtaggagggaaatagaaaactttggtgccacaaaagcaaagtatgtatggtattgccaataatagctaccatctattgagtgctttactacctgtcaggtactgtattatataaactccattttaactgtacctcattttgcagatactcaggcacaaggaggtggttatttgtccaaactggaaccaagattcaaacccagacagagtcttaagcacatttttaatcactaactaacttgagatgcctaaatgccaaatactgttgggagttcaagtggttcttgattagcaaaatctatttttattagtgcaaaagaaacaccacagcttataaagtattatgaattcaataaatggagtcttaactaatgagatattattttctagaatggtgtagctgagagtatgtgtgattcaactgaaaggaataatgtttaatcagtgactcttactatatacaggaaaaggtgcagttctgtctttcaaatctgcctccttaccatattggcttacatccctcatgctgttttcttgtgtttgctagaaagttgttgccaagccaaatgtcatggccatgttgaaggcaaggaagaaaaaatggaaatggcctgtgccagctatatatatcgccttttatgagggaaagcaaagctttctcagaaatcccaaatggattttcccttgacttaattgcctgaccagttaaatggccactggtacctgcaaagaaagcagggtacatagctgtcccaaataaaatcagtattagcaagaagaaagaatattgagaaagcaattaacagtgtctgtgactgtgacatgtctgtgactttatattgtcaagtcctttccccttgaatatagttttggaagaattagctgaaggagtgtgttgacattgaatggccaagagaatgggctgtagcagacatctgtcatttctcttttggctgcccagtatcctaactcctgtgtttaaggaatccctcacctaatgaggcagagcatttcttcctcctaaagaatttgaaagtaccaggtaatgttttctcagcctccttttgcagctaaggaagaaacatctgccttcaattttaaaattagtgatacaaagaaggagggaaccatgcagattcctttgaagatggtgattaacaacactactgcattcatctccacagaggtacagcaaaagtgatttagttagcgataacctctaattctatttttttatttttattttttgagacagtcttgctctgtcaaccaggctggagtgcagtagcactgtcttaactcactgcaacctccacctcctgggttcaagcgattctcctgcctcagcctcccaagtcgctgggattacaagtgcccaccaccatgcacagctaatttttgtgtttttagtagatggggtttctccatgttggccaggctggtctcgaacttatgacttcaggtgatccgcccgccttggcctcccaaagtgctgggattataggcgtgagccactgtgcctggcctgtaacctctaattcttgtttgctggctgtcctagagatcctgagaattacttttaataaaatcatttttttgctgttattaaaactaacctgaattgcctaaaaccaagaactctgcttgataaaataagcatagttttaggaacagccatgcagatataaattttatcaacactttatacataatttgggacttatatttaaatgtaatatttgatgcttataaaagggtaaatggggaatgcaaataaattatcaagcataataactcatcacctaacttaagaataacattatgagtgcttgtattttatctatttgagctcttctcctatctttgccgacccccccgctctctttttaatagatttgttcgaatgtagaaagacctaaaatacatatgtatccctaaagtgacttattttatagttttctttctttttgaacttcaaaaaaattgtatcatactctatgtagtctaaggatttggtttttttcactcaacatgtctctagaattcacaagttttattgttttatagctgtcattttcattgatgtatatttcattgttgggttatacaacatattgttaaggaatacatacatatataataaattatacattttttaaaaaaa

SEQ ID NO: 187592 - DNA, 1004 bp, Homo sapiens
  Payload ID: 16925
  Gene Symbol: ST20
  Gene Name: suppressor of tumorigenicity 20
  Uniprot ID: Q9HBF5
  ENST ID: ENST00000478497
  CDS Start-End: 681-920
gtttgttcctaaatctaatcgagctcccaaggaactagtatcttatagaacacacatagaaaatagtgctctacagtagtcactttcacatttttttcttggatccaacttcatgataagaaatacattttaactcataatctattcacatgtatatgaataactgaaacagaagtttcacaaaattatgattatgtttgccacaaatggtgtgctctaatattttccttctgtttcatcagaagaaaaatactggttactatccagctaagctgattttgtgacccattaatgagtttcagttctcactttgaaaacactgttctagaattacagaaaggtctagggatgagaactaacaccactgtgcatcacagtgtgtcagtctgtgccaggcagcttataaatattttttgcctctaatttttatacatttatgaggtaagtatcattttctaggtaaggatgctaatctgtctccaagccaaataacacacagtaaatcatggcaccaggatttgaatctgggtctttatacatcatagcccatgctgttctcactgtattttgctttttccaagtataaccccgttttcacacgaatggccccttcacatatttgaagactaccgtcgtgtccgtgctgaccctttctccctgccacacatggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtattttt

SEQ ID NO: 187593 - DNA, 529 bp, Homo sapiens
  Payload ID: 16925
  Gene Symbol: ST20
  Gene Name: suppressor of tumorigenicity 20
  Uniprot ID: Q9HBF5
  ENST ID: ENST00000485386
  CDS Start-End: 263-502
cccgaatcccggacctgcgctgaggaggcggttcatctgtggccagcggtgcttcgggacccgcgctgggggaaccctggcgacggggcctggccctgctatatgcgggggcctcggctggagtgagcggcgtggacgcctctttcctccggctcttcccttgttgctgcgagagcgagagggccgcgggcggcggaggcagcggggccgggatggaggacgttaactctaacgtgaacgcggaccaggaggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttga

SEQ ID NO: 187594 - DNA, 694 bp, Homo sapiens
  Payload ID: 16925
  Gene Symbol: ST20
  Gene Name: suppressor of tumorigenicity 20
  Uniprot ID: Q9HBF5
  ENST ID: ENST00000562759
  CDS Start-End: 364-603
cccaaaagggctacttgccttctccttccacttacccagacccctgcctcccttacccttctgctaggaacatgtctacaactatataaattcgtgtaattttgacatgatatttgaaaaagacaatttgggcagtaaatagcagaattaagtagtgtcttaatgtaaatggtttgtgttaccacaatacactgttctagccaaagcacattgcatgtgactcctgttgcactagtttttagtagcaaaaatgaacctgtaaaagaatgtaggttttaaggctttggtaatataagttatttctttcttatttatttatttatttttaagagagtttcattctgtcgcccaggctggagtgcaatggcgcgatctcggctcactgcaacctctgtctcccaggttcaggaaaatggctttgtaaagaagcttgagcctaaatctggctggatgacttttctagaagttacaggaaagatctgtgaaatgctcttctgtcctgaagcaatactgttgaccagaaaggacactccatattgtgaaaccggcctaatttttctgactcttacgaaaacgattgccaacacatacttctacttttaaataaacaactttgatgatgtaacttgaccttccagagttacagaaattttgtccctatttaatgaataaattgtatgtatttttctctata

SEQ ID NO: 187595 - DNA, 2978 bp, Homo sapiens
  Payload ID: 16926
  Gene Symbol: SUV39H1
  Gene Name: suppressor of variegation 3-9 homolog 1 (Drosophila)
  Uniprot ID: O43463
  ENST ID: ENST00000337852
  CDS Start-End: 267-1538
gatcaactatccacgctgctcgaatcacagcatgctggagggcctggctgggtgctctgactgactgatcacctgacagacggtgcggtcagtcggatgctgagaatgactgacgatgtgatgaggggcggattgaacgagtcacaggccagctggccaggagcaaaatcggcatagctgtctgactcgatggctgtacgtggttacggactgtctgccctgatagaatctcagcttcaacgcatcagaggagactgacttgaccaatggtggggatgagtcgcctgagaaatgacagactggctgacccactgacaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccggccccccagactaacctccaggcatggactgaatctggttctcctcttgtacacccctcaaccctatgcagcctggagtgggcatcaataaaatgaactgtcgactg

SEQ ID NO: 187596 - DNA, 2871 bp, Homo sapiens
  Payload ID: 16926
  Gene Symbol: SUV39H1
  Gene Name: suppressor of variegation 3-9 homolog 1 (Drosophila)
  Uniprot ID: O43463
  ENST ID: ENST00000376687
  CDS Start-End: 191-1429
gcggcgagcacccgcctccgggaccgagccgggcggcagggaggggttcggtcacggctctccggttggtccgcgcgggtgctgcgagtcgggagccgcggccaataggctgcgcgttcccggccacgcccgcgcgagcgctcttctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccggccccccagactaacctccaggcatggactgaatctggttctcctcttgtacacccctcaaccctatgcagcctggagtgggcatcaataaaatgaactgtcgactgaa

SEQ ID NO: 187597 - DNA, 3087 bp, Homo sapiens
  Payload ID: 16927
  Gene Symbol: SUV39H2
  Gene Name: suppressor of variegation 3-9 homolog 2 (Drosophila)
  Uniprot ID: Q9H5I1
  ENST ID: ENST00000313519
  CDS Start-End: 232-1284
cggggccgaggcgcgaggaggtgaggctggagcgcggccccctcgccttccctgttcccaggcaagctcccaaggcccgggcggcggggccgtcccgcgggccagccagatggcgacgtggcggttccccgcccgccgcgaccccaactccgggacgcacgctgcggacgcctatcctcccccaggccgctgacccgcctccctgcccggccggctcccgccgcggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctccaaaaaaaaaaaa

SEQ ID NO: 187598 - DNA, 1233 bp, Homo sapiens
  Payload ID: 16927
  Gene Symbol: SUV39H2
  Gene Name: suppressor of variegation 3-9 homolog 2 (Drosophila)
  Uniprot ID: Q9H5I1
  ENST ID: ENST00000354919
  CDS Start-End: 1-1233
atggcggcggtcggggccgaggcgcgaggagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactga

SEQ ID NO: 187599 - DNA, 1611 bp, Homo sapiens
  Payload ID: 16927
  Gene Symbol: SUV39H2
  Gene Name: suppressor of variegation 3-9 homolog 2 (Drosophila)
  ENST ID: ENST00000358298
  CDS Start-End: 1-530
cttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagt

SEQ ID NO: 187600 - DNA, 1292 bp, Homo sapiens
  Payload ID: 16927
  Gene Symbol: SUV39H2
  Gene Name: suppressor of variegation 3-9 homolog 2 (Drosophila)
  Uniprot ID: Q9H5I1
  ENST ID: ENST00000378325
  CDS Start-End: 27-719
gccagtttgaatgaaagctctacaagatggcggcggtcggggccgaggcgcgaggagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaa

SEQ ID NO: 187601 - DNA, 2959 bp, Homo sapiens
  Payload ID: 16927
  Gene Symbol: SUV39H2
  Gene Name: suppressor of variegation 3-9 homolog 2 (Drosophila)
  ENST ID: ENST00000378331
  CDS Start-End: 70-207
aggggcggggcgtcgggccagctgagctatcccgtcagaccgcgccagtttgaatgaaagctctacaagatggcggcggtcggggccgaggcgcgaggaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgttggagaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaagagggtcagaacagtatgtaaatgtggagctgtgacttgcagaggttacctcaactgaactttttcaggaaatagagctgatgattataatatttttttcctaatgttaacatttttaaaaatacatatttgggactcttattatcaaggttctacctatgttaatttacaattcatgtttcaagacatttgccaaatgtattaccgatgcctctgaaaagggggtcactgggtctcatagactgatatgaagtcgacatatttatagtgcttagagaccaaactaatggaaggcagactatttacagcttagtatatgtgtacttaagtctatgtgaacagagaaatgcctcccgtagtgtttgaaagcgttaagctgataatgtaattaacaactgctgagagatcaaagattcaacttgccatacacctcaaattcggagaaacagttaatttgggcaaatctacagttctgtttttgctactctattgtcattcctgtttaatactcactgtacttgtatttgagacaaataggtgatactgaattttatactgttttctacttttccattaaaacattggcacctcaatgataaagaaatttaaggtataaaattaaatgtaaaaattaatttcagcttcatttcgtatttcgaagcaatctagactgttgtgatgagtgtatgtctgaacctgtaattcttaaaagacttcttaatcttctagaagaaaaatctccgaagagctctctctagaagtccaaaatggctagccattatgcttctttgaaaggacatgataatgggaccaggatggttttttggagtaccaagcaaggggaatggagcactttaagggcgcctgttagtaacatgaattggaaatctgtgtcgagtacctctgatctaaacggtaaaacaagctgcctggagagcagctgtacctaacaatactgtaatgtacattaacattacagcctctcaatttcaggcaggtgtaacagttcctttccaccagatttaatatttttatacttcctgcaggttcttcttaaaaagtaatctatatttttgaactgatacttgttttatacataaattttttttagatgtgataaagctaaacttggccaaagtgtgtgcctgaattattagacctttttattagtcaacctacgaagactaaaatagaatatattagttttcaagggagtgggaggcttccaacatagtattgaatctcaggaaaaactattctttcatgtctgattctgagatttctaattgtgttgtgaaaatgataaatgcagcaaatctagctttcagtattcctaatttttacctaagctcattgctccaggctttgattacctaaaataagcttggataaaattgaaccaacttcaagaatgcagcacttcttaatctttagctctttcttgggagaagctagactttattcattatattgctatgacaacttcactctttcataatatataggataaattgtttacatgattggaccctcagattctgttaaccaaaattgcagaatggggggccaggcctgtgtggtggctcacacctgtgatcccagcactttgggaggctgaggtaggaggatcacgtgaggtcgggagttcaagaccagcctggccatcatggtgaaaccctgtctctactgaaaatacaaaaattagccgggcgtggtggcacacgcctgtagtcccagctactcaggaggctgaggcaggagaatcacttgaattcaggaggcggaggttgcagtgagccaagatcataccactgcactgcagcctgagtgacacagtaagactgtctccaaaaaaaaaaaa

SEQ ID NO: 187602 - DNA, 688 bp, Homo sapiens
  Payload ID: 16927
  Gene Symbol: SUV39H2
  Gene Name: suppressor of variegation 3-9 homolog 2 (Drosophila)
  ENST ID: ENST00000412254
  CDS Start-End: 402-688
tgaactatttaattttgtcagtgaaatctttttctgcattactggagactgtcgagagattgtctttctttttttaaccacgtgtttgcagtttttcatgttcactttttttttttttttaattttcaaagagcatttcctttgcgggttgtgttttgaatcctcaactagataaaaatgtttaggaaaagcacacaaacacaccttgagtagataagaggaacctcctttatacgtgattcccttaatgagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgt

SEQ ID NO: 187603 - DNA, 719 bp, Homo sapiens
  Payload ID: 16927
  Gene Symbol: SUV39H2
  Gene Name: suppressor of variegation 3-9 homolog 2 (Drosophila)
  ENST ID: ENST00000433779
  CDS Start-End: 263-719
atcccgtcagaccgcgccagtttgaatgaaagctctacaagatggcggcggtcggggccgaggcgcgaggaggtgaggctggagcgcggccccctcgccttccctgttcccagcttggtgtgtgccttgcctagtttcacttgatactcttcaggaattatgtagaaaagaaaagctcacatgtaaatcgattggaatcaccaaaaggaatctaaacaattatgaggtggaatacttgtgtgactacaaggtagtaaaggatatggaatattatcttgtaaaatggaaaggatggccagattctacaaatacttgggaacctttgcaaaatctgaagtgcccgttactgcttcagcaattctctaatgacaagcataattatttatctcaggtaatcacaagtgaagaagctgaaagacgaggacagttctatgacaacaagggaatcacgtatctctttgatctggactatgagtctgatgaattcacagtggatgcggctcgatacggcaatgtgtctcattttgtgaatcacagctgtgacccaaatcttcaggtgttcaatgttttcattgataacctcgatactcgtcttccccgaatagcattgttttccacaagaaccataaatgctggagaagagctgacttttgattatcaaatgaaaggttctggagatatatcttcagattctattgaccacagcccagccaaaaaga

SEQ ID NO: 187604 - DNA, 704 bp, Homo sapiens
  Payload ID: 16927
  Gene Symbol: SUV39H2
  Gene Name: suppressor of variegation 3-9 homolog 2 (Drosophila)
  ENST ID: ENST00000420416
  CDS Start-End: 43-704
gaggctggagcgcggccccctcgccttccctgttcccaggatatggaatattatcttgtaaaatggaaaggatggccagattctacaaatacttgggaacctttgcaaaatctgaagtgcccgttactgcttcagcaattctctaatgacaagcataattatttatctcaggtaaagaaaggcaaagcaataactccaaaagacaataacaaaactttgaaacctgccattgctgagtacattgtgaagaaggctaaacaaaggatagctctgcagagatggcaagatgaactcaacagaagaaagaatcataaaggaatgatatttgttgaaaatactgttgatttagagggcccaccttcagacttctattacattaacgaatacaaaccagctcctggaatcagcttagtcaatgaagctacctttggttgttcatgcacagattgcttctttcaaaaatgttgtcctgctgaagctggagttcttttggcttataataaaaaccaacaaattaaaatcccacctggtactcccatctatgaatgcaactcaaggtgtcagtgtggtcctgattgtcccaataggattgtacaaaaaggcacacagtattcgctttgcatctttcgaactagcaatggacgtggctggggtgtaaagacccttgtgaagattaaaagaatgagttttgtcatggaatatgt

SEQ ID NO: 187605 - DNA, 5837 bp, Homo sapiens
  Payload ID: 16928
  Gene Symbol: SUV420H1
  Gene Name: suppressor of variegation 4-20 homolog 1 (Drosophila)
  Uniprot ID: Q4FZB7
  ENST ID: ENST00000304363
  CDS Start-End: 355-3012
gggcgcggggggcgcgacggcggcggcggcggccggttgggggcggggggctcggacgctgcggggactcatttttcccgtcagcggagggagcgagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaatgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggggggatattgtttcaatgacgctccttaagactgttgattgcccataggttccaaatagaaattaagactcatgaacatttttagaaagtagattgttttctcctggttctctaaggaactacttctgcagtcttacatagtctcatccttgtttgttgtggtgcagtcgaactcctcaggcgtttggaaagcatgtggtagaccttcttccacacccacccatacccccgttcactgcgtctggaggtcttcaacagtgaagtagggcagcccacacagcctctcaggagcacctgtccgaggcacccggagcactttgcagagcacgtccagccctcatggggtccctgcatagaaatgtgaacccctgccactgaggaagatgaaggtagaccctgtgtctggaggtgctggagggcagcgggtcacctcttgtattcccaccttagtttggggtgttttgaagaggttcagagactaaatcttaaaccttatttgaataccaacgatagctattttgggaatttcgatcttaaaaagtgacaaaacacatttcccattttcatttttcagctgaattttagtaacttatttttgatgttttaattttatcatggcctcctctttggaggccaaccttcccatgggtctcaaagcagtgacatttggtagtaaatcactgcctctcaggagtcggtatgcacaagcactcagcagccactgttgatgccttctagggaaacctaatttccgttggtaaaggtaggggcctcggaactgttccggatctgctgtagaacttcaccgtgtggaatggtgacagccacacaccgttgaccagtttagaagaggttgcattcaataaaactcttagcttgagcttatgcaatgattggttaagattttggcattgtaagaattaggagatgatcatagaaatatatgtaaagtattcaattttcaatcattttcaaattactgttataaattgtttttgctgagttgtaatacttttgagatacaatgtattccttgtactgaaagaatgaaaaaggactttttcagcatttgaggtaagttctttaacgtttcattaaaaacattttttacaaatattttgtacatgcacttgcagtattgaggttaatcattttaataaattcggaaattaaaacaa

SEQ ID NO: 187606 - DNA, 653 bp, Homo sapiens
  Payload ID: 16928
  Gene Symbol: SUV420H1
  Gene Name: suppressor of variegation 4-20 homolog 1 (Drosophila)
  ENST ID: ENST00000323599
  CDS Start-End: 1-311
aatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacataggcagaatcttgctctgtcacccaggctggagtgcagtggcctgattatggctcactgcagcttccatctcttgggctcaagtgattcttcctctcagcctcccacgtagctggcactaaaggtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtg

SEQ ID NO: 187607 - DNA, 1881 bp, Homo sapiens
  Payload ID: 16928
  Gene Symbol: SUV420H1
  Gene Name: suppressor of variegation 4-20 homolog 1 (Drosophila)
  ENST ID: ENST00000402185
  CDS Start-End: 202-1314
gcagcggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctact

SEQ ID NO: 187608 - DNA, 1599 bp, Homo sapiens
  Payload ID: 16928
  Gene Symbol: SUV420H1
  Gene Name: suppressor of variegation 4-20 homolog 1 (Drosophila)
  ENST ID: ENST00000402789
  CDS Start-End: 196-1404
gggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaaagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgac

SEQ ID NO: 187609 - DNA, 2869 bp, Homo sapiens
  Payload ID: 16928
  Gene Symbol: SUV420H1
  Gene Name: suppressor of variegation 4-20 homolog 1 (Drosophila)
  Uniprot ID: Q4FZB7
  ENST ID: ENST00000405515
  CDS Start-End: 429-1610
ggcacagaactcgctccccgcgcgtgcccgcgtcccgcacagagccccgtggaagcgccgcggcggctgggcctggcgggaggcgcgcgcacactgtggcagctgcgccgcacggtgtccctccgccgtcgaggccgcggccttcttttcgtatccttccaccgtgcccgggcggggtccaggcggctcaccgggggcggcgacgcggcggcggtgcgggcggcagggcagcggggcgatgaggtgaggacgcccgggaaccggaggcggcaccgcgcggcgcacggacctgggacgcggagtcctgaagccggcggacggttttcgtacgggcggccgtgcgcgaggcgaggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgattattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgaccatt

SEQ ID NO: 187610 - DNA, 2666 bp, Homo sapiens
  Payload ID: 16928
  Gene Symbol: SUV420H1
  Gene Name: suppressor of variegation 4-20 homolog 1 (Drosophila)
  Uniprot ID: Q4FZB7
  ENST ID: ENST00000401547
  CDS Start-End: 226-1407
ttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaagtaagtaagggagatttgataagcatatcttttaaaagtattttcacacaatttgctttataaagtgtgcttcagtagttttaaacttttaaatactcagagagactgggacttgtgagctttggctgcacttcaaggctctagacgtgatttgagtagaggcacagtctgtatcccatctctaacttcagtaccgtcctctagactatttttcttgaataccttggtaactggatatgagttcttcatcatatgttccaaggtcatcatatgttttaaacattttcaaggtgttagagactgtgatgatgtcgctaagtcctgcaagaagacaaaaggactgagtagaattaaattagactctatacattccagtgcctagccagtttgttagaaaagatgatggacttggggaattcatagcttctggccttaaggcttccaccttttcattgcttgctgacctttttcaaaacgaactgactcagttcagcagaccaccagtaccagactcagaattgtgatagaggagcattttgaacagtgccgtattgtgacatgctgtattggctactccagaaagtaggagtaaagatggaaaggagaaagaagcaacctctgagattccagtggtgtgtgggggcaagatctgatggaaactgaaaaagagaacgaagactaaacaaagagaaaggaaagagaagaaaccctaaatgggcaaaggaaagcacatcctgtttgcggagctttgaaatattggaaccatttctaattgctcctgtttttctgggtaacaccagttttctgtagttgccactaaagcagtagactcttgagtctcacttgtctctgagagagacagaagttagaaagttttgacttggcgattccgaaagtatgcctttgttggcacttaaatgtccagtgagacttcttggcaccttagagccctctgagatactgattattttaggttcttctccctactttcagatgttttcagcccaacactgggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataataaatgcagcataacgaccatt

SEQ ID NO: 187611 - DNA, 2475 bp, Homo sapiens
  Payload ID: 16928
  Gene Symbol: SUV420H1
  Gene Name: suppressor of variegation 4-20 homolog 1 (Drosophila)
  ENST ID: ENST00000427752
  CDS Start-End: 355-834
gggcgcggggggcgcgacggcggcggcggcggccggttgggggcggggggctcggacgctgcggggactcatttttcccgtcagcggagggagcgagcggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagtggggagacagaaaaaccaaatagcaagaaaacctgggaagtgagtctctggaaagagtggggaacagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaa

SEQ ID NO: 187612 - DNA, 585 bp, Homo sapiens
  Payload ID: 16928
  Gene Symbol: SUV420H1
  Gene Name: suppressor of variegation 4-20 homolog 1 (Drosophila)
  ENST ID: ENST00000434573
  CDS Start-End: 232-585
tttttgtttttgttttggcccgagcgcatttcggagccctcccgagctcgtcctgcagcccaccctcctccccgacggcgcccctggccgtggcccggcgaccccgcggccgctgcgtcccctttgtgctttatccgctctccctgcgtcccctggagagaacattgaaagtattctctaagctatttgaagagagtgactaaatgcacctgggtcaggctgtctgtgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagt

SEQ ID NO: 187613 - DNA, 556 bp, Homo sapiens
  Payload ID: 16928
  Gene Symbol: SUV420H1
  Gene Name: suppressor of variegation 4-20 homolog 1 (Drosophila)
  ENST ID: ENST00000458496
  CDS Start-End: 256-556
gtatccttccaccgtgcccgggcggggtccaggcggctcaccgggggcggcgacgcggcggcggtgcgggcggcagggcagcggggcgatgaggtgaggacgcccgggaaccggaggcggcaccgcgcggcgcacggacctgggacgcggagtcctgaagccggcggacggttttcgtacgggcggccgtgcgcgaggcgaggtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaata

SEQ ID NO: 187614 - DNA, 594 bp, Homo sapiens
  Payload ID: 16928
  Gene Symbol: SUV420H1
  Gene Name: suppressor of variegation 4-20 homolog 1 (Drosophila)
  ENST ID: ENST00000453170
  CDS Start-End: 234-594
ggtgctgcggcccgcgccgccatcttggattttactctccatttttctctggaattatttttggtgattaattttctgggggggactgggacgcggggcccggcggcgcggccccgcatcgcagcggccgggcagcggggcctgggacgcgccccgaggaggagcggggcggcgcaggcggtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactg

SEQ ID NO: 187615 - DNA, 2816 bp, Homo sapiens
  Payload ID: 16928
  Gene Symbol: SUV420H1
  Gene Name: suppressor of variegation 4-20 homolog 1 (Drosophila)
  ENST ID: ENST00000441488
  CDS Start-End: 6-842
tgggtatgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgatcttatcaacagttaattgactttatcttttggacatttttcagattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttca

SEQ ID NO: 187616 - DNA, 4306 bp, Homo sapiens
  Payload ID: 16928
  Gene Symbol: SUV420H1
  Gene Name: suppressor of variegation 4-20 homolog 1 (Drosophila)
  Uniprot ID: Q4FZB7
  ENST ID: ENST00000615954
  CDS Start-End: 1-2658
atgaagtggttgggagaatccaagaacatggtggtgaatggcaggagaaatggaggcaagttgtctaatgaccatcagcagaatcaatcaaaattacagcacacggggaaggacaccctgaaggctggcaaaaatgcagtcgagaggaggtcgaacagatgtaatggtaactcgggatttgaaggacagagtcgctatgtaccatcctctggaatgtccgccaaggaactctgtgaaaatgatgacctagcaaccagtttggttcttgatccctatttaggttttcaaacacacaaaatgaatactagcgcctttccttcgaggagctcaaggcatttttcaaaatctgacagtttttctcacaacaaccctgtgagatttaggcctattaaaggaaggcaggaagaactaaaggaagtaattgaacgttttaagaaagatgaacacttggagaaagccttcaaatgtttgacttcaggcgaatgggcacggcactattttctcaacaagaataaaatgcaggagaaattattcaaagaacatgtatttatttatttgcgaatgtttgcaactgacagtggatttgaaatattgccatgtaatagatactcatcagaacaaaatggagccaaaatagttgcaacaaaagagtggaaacgaaatgacaaaatagaattactggtgggttgtattgccgaactttcagaaattgaggagaacatgctacttagacatggagaaaacgacttcagtgtcatgtactccacaaggaaaaactgtgctcaactctggctgggtcctgctgcgtttataaaccatgattgcagacctaattgtaagtttgtgtcaactggtcgagatacagcatgtgtgaaggctctaagagacattgaacctggagaagaaatttcttgttattatggagatgggttctttggagaaaataatgagttctgcgagtgttacacttgcgaaagacggggcactggtgcttttaaatccagagtgggactgcctgcgcctgctcctgttatcaatagcaaatatggactcagagaaacagataaacgtttaaataggcttaaaaagttaggtgacagcagcaaaaattcagacagtcaatctgtcagctctaacactgatgcagataccactcaggaaaaaaacaatgcaacttctaaccgaaaatcttcagttggcgtaaaaaagaatagcaagagcagaacgttaacgaggcaatctatgtcaagaattccagcttcttccaactctacctcatctaagctaactcatataaataattccagggtaccaaagaaactgaagaagcctgcaaagcctttactttcaaagataaaattgagaaatcattgcaagcggctggagcaaaagaatgcttcaagaaaactcgaaatgggaaacttagtactgaaagagcctaaagtagttctgtataaaaatttgcccattaaaaaagataaggagccagagggaccagcccaagccgcagttgccagcgggtgcttgactagacacgcggcgagagaacacagacagaatcctgtgagaggtgctcattcgcagggggagagctcgccctgcacctacataactcggcggtcagtgaggacaagaacaaatctgaaggaggcctctgacatcaagcttgaaccaaatacgttgaatggctataaaagcagtgtgacggaaccttgccccgacagtggtgaacagctgcagccagctcctgtgctgcaggaggaagaactggctcatgagactgcacaaaaaggggaggcaaagtgtcataagagtgacacaggcatgtccaaaaagaagtcacgacaaggaaaacttgtgaaacagtttgcaaaaatagaggaatctactccagtgcacgattctcctggaaaagacgacgcggtaccagatttgatgggtccccattctgaccagggtgagcacagtggcactgtgggcgtgcctgtgagctacacagactgtgctccttcacccgtcggttgttcagttgtgacatcagatagcttcaaaacaaaagacagctttagaactgcaaaaagtaaaaagaagaggcgaatcacaaggtatgatgcacagttaatcctagaaaataactctgggattcccaaattgactcttcgtaggcgtcatgatagcagcagcaaaacaaatgaccaagagaatgatggaatgaactcttccaaaataagcatcaagttaagcaaagaccatgacaacgataacaatctctatgtagcaaagcttaataatggatttaactcaggatcaggcagtagttctacaaaattaaaaatccagctaaaacgagatgaggaaaatagggggtcttatacagaggggcttcatgaaaatggggtgtgctgcagtgatcctctttctctcttggagtctcgaatggaggtggatgactatagtcagtatgaggaagaaagtacagatgattcctcctcttctgagggcgatgaagaggaggatgactatgatgatgactttgaagacgattttattcctcttcctccagctaagcgcttgaggttaatagttggaaaagactctatagatattgacatttcttcaaggagaagagaagatcagtctttaaggcttaatgcctaagctcttggtcttaacttgacctgggataactactttaaagaaataaaaaattccagtcaattattcctcaactgaaagtttagtggcagcacttctattgtcccttcacttatcagcatactattgtagaaagtgtacagcatactgactcaattcttaagtctgatttgtgcaaatttttatcgtactttttaaatagccttcttacgtgcaattctgagttagaggtaaagccctgttgtaaaataaaggctcaagcaaaattgtacagtgatagcaactttccacacaggacgttgaaaacagtaatgtggctacacagtttttttaactgtaagagcatcagctggctctttaatatatgactaaacaataatttaaaacaaatcatagtagcagcatattaagggtttctagtatgctaatatcaccagcaatgatctttggctttttgatttatttgctagatgtttcccccttggagttttgtcagtttcacactgtttgctggcccaggtgtactgtttgtggcctttgttaatatcgcaaaccattggttgggagtcagattggtttcttaaaaaaaaaaaaaaaatgacatacgtgacagctcacttttcagttcattatatgtacgagggtagcagtgtgtgggatgaggttcgatacagcgtatttattgcttgtcatgtaaattaaaaaccttgtatttaactcttttcaatccttttagataaaattgttctttgcaagaatgattggtgcttattttttcaaaaatttgctgtgaacaacgtgatgacaacaagcaacatttatctaatgaactacagctatcttaatttggttcttcaagttttctgttgcacttgtaaaatgctacaaggaatattaaaaaaatctattcactttaacttataatagtttatgaaataaaaacatgagtcacagcttttgttctgtggtaacctataaaaaaagtttgtctttgagattcaatgtaaagaactgaaaacaatgtatatgttgtaaatatttgtgtgttgtgagaaatttttgtcataagaaattaaaagaacttaccaggaaggtttttaagtttagaaatattcatgccaataaaataggaaattataaatatatagttttaagcactgcatcagtgggagttcttggcttatgttagtttatgttagtttattatgaaaacatcaaagatttttttgactatattatcagttaaacaaaaaggagtcagatttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttggg

SEQ ID NO: 187617 - DNA, 2308 bp, Homo sapiens
  Payload ID: 16929
  Gene Symbol: SUV420H2
  Gene Name: suppressor of variegation 4-20 homolog 2 (Drosophila)
  Uniprot ID: Q86Y97
  ENST ID: ENST00000255613
  CDS Start-End: 249-1637
gagcagatgggaggtgcggcgacagtgtttgacgagagccgaaggaggctgtgggaggtgttggcggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcagccctgtgccccccctgcggcgacagcagcacctgcgctcagcgctggaaactttcctgaggcagcgggacctggaggctgcgtaccgggccctgacgctgggaggctggacggcccgctacttccagagccggggcccgcggcaggaggctgccctcaagacccacgtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagc

SEQ ID NO: 187618 - DNA, 2077 bp, Homo sapiens
  Payload ID: 16929
  Gene Symbol: SUV420H2
  Gene Name: suppressor of variegation 4-20 homolog 2 (Drosophila)
  Uniprot ID: Q86Y97
  ENST ID: ENST00000445196
  CDS Start-End: 184-477
ggcggcggcgcgggcgcctgaggaggaggaggagaagcggatgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcaggtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagc

SEQ ID NO: 187619 - DNA, 869 bp, Homo sapiens
  Payload ID: 16929
  Gene Symbol: SUV420H2
  Gene Name: suppressor of variegation 4-20 homolog 2 (Drosophila)
  Uniprot ID: Q86Y97
  ENST ID: ENST00000592631
  CDS Start-End: 97-390
tgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcaggtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcggtgagcacccctccctgccatcccagcagcccctcccctgtctg

SEQ ID NO: 187620 - DNA, 2037 bp, Homo sapiens
  Payload ID: 16929
  Gene Symbol: SUV420H2
  Gene Name: suppressor of variegation 4-20 homolog 2 (Drosophila)
  ENST ID: ENST00000630497
  CDS Start-End: 323-1366
atgagatcgtggggctcaccagcgtcccccatggcttctgagtagcgtgggagtggagtcagcaccaagccaggctccccgcgcctgccttgccctcacctgctcctgctctctgccagaggcagcatggtccgcagggcaccatggggcccgacagagtgacagcacgagaactgtgcgagaacgacgacctggccaccagcctcgtcctggacccctacctcggtttccgcacccataagatgaacgtcaggtctatcgctacctccgtgccttcctgccggaaagtggctttaccatcctgccctgcacgcgctactccatggagaccaacggggccaagatcgtgtccactcgtgcttggaaaaagaatgagaagctggagctgctggtgggctgcattgcagagctgcgggaggcagatgaggggctgctgagggccggtgagaatgacttcagcatcatgtactcaacccgcaagcggagtgctcagctgtggctgggcccagccgccttcatcaaccatgactgcaaacccaactgcaagtttgtgcctgcagatgggaacgcagcctgcgtgaaggtgctccgggacattgagcctggggacgaggtgacatgcttctacggcgagggcttcttcggcgagaagaatgagcactgtgaatgccacacctgtgagaggaaaggtgaaggagctttccgaaccaggcctagggagcccgcgttgccaccacggcccctggacaagtaccagctgcgtgagaccaagcggcggctgcagcaaggcctggacagtggcagccgacagggcctgctgggccctcgggcctgcgtgcacccatccccgctgcgccgggacccattctgcgccgcctgccagcccctgcgcctgccagcctgcagcgcccgcccagacacctcacccctctggctccagtggctgcctcagccccagccccgagtgcggccccggaagcgccgacgcccccggccccggagggccccagtgctctccacccaccacgctgcccgcgtctccctgcaccgatggggaggctgtggcccccactgccgcctgcgaggagaggccctggtggccctgggccagcccccccacgcccgctgggcccctcagcaggactggcactgggcccggcgctatgggctgccttacgtggtgcgtgtggaccttcgtcgcctggccccagccccaccagctaccccagcccctgctgggaccccaggccccatcctgatcccgaagcaggccctcgccttcgcccccttctccccacccaagcgcctacggctggtggtcagccacggctccatcgacctggatgtcggcggtgaagagctgtgacaggccggacggggaggcccagcagggagagagggtctctctcctagctgctacccaggacctccagaaggagcccttggacctctgggagggagctgacccttgactccagcatagctctgaccctggaatggggttggtttggacacccccagggatctgagccctgaccctttgtgactgctgacccctgagccacccccactcccacagggagccccggccatttgctgccctccccacccctgccccagcctcaggactgcaggagccatccgcccccctcagccccttcctccccagggagcaaagccataaggggcaggggccaccccacggcatctccccagaagtacaggcctcaggaggaggtggaactgatgtagggggtggcactccccagagactgccctcacgaggggactgggttcgctctcagctctgcagctgtctgcggtggggggaaggttggggggtgtctggaggcatgttcccctcaccaccccccgtgggtctcagggaggccgggtgtgacctcatctttctcatggtgctatcctggtgctattggggtggggagctccctcccctcccccacaccagaaaggggtatgttgggggcttggaagcacttgaactttttattttattaaaaccttgttataagcagc

SEQ ID NO: 187621 - DNA, 957 bp, Homo sapiens
  Payload ID: 16930
  Gene Symbol: SBSN
  Gene Name: suprabasin
  Uniprot ID: Q6UWP8
  ENST ID: ENST00000518157
  CDS Start-End: 71-814
gggagagaggataaatagcagcgtggcttccctggctcctctctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacta

SEQ ID NO: 187622 - DNA, 1945 bp, Homo sapiens
  Payload ID: 16930
  Gene Symbol: SBSN
  Gene Name: suprabasin
  Uniprot ID: Q6UWP8
  ENST ID: ENST00000452271
  CDS Start-End: 30-1802
tctgcatccttcccgaccttcccagcaatatgcatcttgcacgtctggtcggctcctgctccctccttctgctactgggggccctgtctggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacaggttgggaaggaggcagacaaactgatccatcatggggtccatcacggggccaaccaggcgggaagtgaggcagggaagtttggccagggagtcgacaatgctgcagggcaggctggaaatgaggctgggaggtttggccagggagtccaccatgctgcagggcaggccggaaatgaggctgggaggtttggccagggagtccaccatgctgcagggcaggccggaaatgaggctgggagatttggccagggggcccaccatggtctcagtgagggctggaaggagacagagaagtttggccaggggatccaccatgctgccggtcaggttgggaaggaggcagagaagtttggccagggggcccaccatgctgcggggcaggccggaaatgaggcagggagatttggccagggggtccaccatggtctcagtgagggctggaaggagacagagaagtttggccagggggtccaccatactgctggtcaggttgggaaggaggcagagaagtttggccagggggcccaccatgctgcggggcaggccggaaatgaggcagggagatttggccagggggcccaccatgctgcggggcaggccggaaatgaggctgggaggtttggccagggggtccaccatggtctcagtgagggctggaaggagacagagaagtttggccagggggtccaccatgctgccagtcagtttgggaaggaaacagagaagctcggccatggggtccaccatggggttaatgaggcctggaaggaagcagagaagtttggccagggtgtccaccatgctgcctcgcaggtggggaaggaggaagacagagtggtccaaggcctccatcatggcgttagtcaggctggaagggaggcggggcagtttggccacgacattcaccacacagcagggcaggctgggaaagagggagacatagcagttcatggtgtccaacctggggtccacgaggccgggaaggaggcagggcagtttggccagggagttcaccatacccttgaacaggccgggaaggaagcagacaaagcggtccaagggttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacta

SEQ ID NO: 187623 - DNA, 593 bp, Homo sapiens
  Payload ID: 16930
  Gene Symbol: SBSN
  Gene Name: suprabasin
  ENST ID: ENST00000588674
  CDS Start-End: 1-450
ggatgggcggccagcgatgaccccattgagaaggtcattgaagggatcaaccgagggctgagcaatgcagagagagaggtgggcaaggccctggatggcatcaacagtggaatcacgcatgccggaagggaagtggagaaggttttcaacggacttagcaacatggggagccacaccggcaaggagttggacaaaggcgtccaggggctcaaccacggcatggacaaggttgcccatgagatcaaccatggtattggacaagcaggaaaggaagcagagaagcttggccatggggtcaacaacgctgctggacagggcaaccatcaaagcggatcttccagccatcaaggaggggccacaaccacgccgttagcctctggggcctcggtcaacacgcctttcatcaaccttcccgccctgtggaggagcgtcgccaacatcatgccctaaactggcatccggccttgctgggagaataatgtcgccgttgtcacatcagctgacatgacctggaggggttgggggtgggggacaggtttctgaaatccctgaagggggttgtactgggatttgtgaataaacttgatacacta

SEQ ID NO: 187624 - DNA, 451 bp, Homo sapiens
  Payload ID: 16931
  Gene Symbol: SFTA2
  Gene Name: surfactant associated 2
  Uniprot ID: Q6UW10
  ENST ID: ENST00000359086
  CDS Start-End: 80-316
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagcggcaataaataaaattcggtatgctgaattcaa

SEQ ID NO: 187625 - DNA, 451 bp, Homo sapiens
  Payload ID: 16931
  Gene Symbol: SFTA2
  Gene Name: surfactant associated 2
  Uniprot ID: Q6UW10
  ENST ID: ENST00000383539
  CDS Start-End: 80-316
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagtggcaataaataaaattcggtatgctgaattcaa

SEQ ID NO: 187626 - DNA, 451 bp, Homo sapiens; identical to SEQ ID NO: 187624
  Payload ID: 16931
  Gene Symbol: SFTA2
  Gene Name: surfactant associated 2
  Uniprot ID: Q6UW10
  ENST ID: ENST00000429290
  CDS Start-End: 80-316

SEQ ID NO: 187627 - DNA, 451 bp, Homo sapiens; identical to SEQ ID NO: 187625
  Payload ID: 16931
  Gene Symbol: SFTA2
  Gene Name: surfactant associated 2
  Uniprot ID: Q6UW10
  ENST ID: ENST00000454649
  CDS Start-End: 80-316

SEQ ID NO: 187628 - DNA, 451 bp, Homo sapiens
  Payload ID: 16931
  Gene Symbol: SFTA2
  Gene Name: surfactant associated 2
  Uniprot ID: Q6UW10
  ENST ID: ENST00000457919
  CDS Start-End: 80-316
ggggtgtagaaacaggcctgttaaggagaggccaccgggacttcagtgtctcctccatcccaggagcgcagtggccactatggggtctgggctgccccttgtcctcctcttgaccctccttggcagctcacatggaacaggaccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccaggcttttgggccggggatgcaggaggcaggccccgaccctgtctttcagcaggcccccaccctcctgagtggcaataaataaaattcggtatgctgaattcaa

SEQ ID NO: 187629 - DNA, 451 bp, Homo sapiens
  Payload ID: 16931
  Gene Symbol: SFTA2
  Gene Name: surfactant associated 2
  ENST ID: ENST00000448586
  CDS Start-End: 80-316
ggggtgtagaaacaggcctgttaaggagaggccaccgggacttcagtgtctcctccatcccaggagcgcagtggccactatggggtctgggctgccccttgtcctcctcttgaccctccttggcagctcacatggaacagggccgggtatgactttgcaactgaagctgaaggagtcttttctgacaagttcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgactctgtctttcagcaggcccccaccctcctgagtggcaataaataaaattcggtatgctgaattcaa

SEQ ID NO: 187630 - DNA, 815 bp, Homo sapiens
  Payload ID: 16931
  Gene Symbol: SFTA2
  Gene Name: surfactant associated 2
  ENST ID: ENST00000634371
  CDS Start-End: 522-689
ccgaggtgtactccccgagggctgggggagcgcattccctcccgtcctactgattaactttcagcaaatggggatgcccaaaggagcagatagcgagtgacctgtggccctgctgtttgattctggatggagttacgtttaggagcctggcagcaaactggggcacctgttcaattagtgatgatgccatactctgtcccggaaatagaaattgtgagtccggttcctcatccaggaaaggggcagagcatggaagagccagggctgggcgcctactccaagatcaccgtggggaagggatctggcccatgccaagattctgctgctccatcaggtagaccgggttgatttctgtggggcacatctgtcccttaccaagaagatcaggccaaggaacaccaggaggagaatcacagccaccaggaccacaataactatggcccatgcagggaatgaatcattctctcccatctgtccagcgtggatacctttctgtgagccatctttattgagggccgggtatgactttgcaactgaagctgaaggagtcttttctgacaaattcctcctatgagtccagcttcctggaattgcttgaaaagctctgcctcctcctccatctcccttcagggaccagcgtcaccctccaccatgcaagatctcaacaccatgttgtctgcaacacatgacagccattgaagcctgtgtccttcttggcccgggcttttgggccggggatgcaggaggcaggccccgaccctgtctttcagcaggcccccaccctcctgagcggcaataaataaaattcggtatgc

SEQ ID NO: 187631 - DNA, 1191 bp, Homo sapiens
  Payload ID: 16932
  Gene Symbol: SFTA3
  Gene Name: surfactant associated 3
  ENST ID: ENST00000521114
  CDS Start-End: 379-609
tccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaagaacaggcctgagggagagggaaaagcggatacccacctgtgtcgctgtttgcgtgccaagtccaggaacagtccatacagccctgctgcatcccacgacgctgtcacaaagcaggagttcatccgaggccaagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatccaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatct

SEQ ID NO: 187632 - DNA, 694 bp, Homo sapiens
  Payload ID: 16932
  Gene Symbol: SFTA3
  Gene Name: surfactant associated 3
  ENST ID: ENST00000524122
  CDS Start-End: 83-313
ggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaaggcctgagggagagggaaaagcggatacccacctgtgtcgctgtttgcgtgccaagtccaggaacagtccatacagccctgctgcatcccacgacgctgtcacaaagcaggagttcatccgaggccaaggtgttgtcatgagaatattcgttaaaatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatccaa

SEQ ID NO: 187633 - DNA, 770 bp, Homo sapiens
  Payload ID: 16932
  Gene Symbol: SFTA3
  Gene Name: surfactant associated 3
  ENST ID: ENST00000518002
  CDS Start-End: 18-305
gatccagataagaggaaatgagagccgggttttctgacttccaactcattagggaccaggttctttttcttcaggatcaggcacagagactgactgaatggctccaattatcaggatttgaaaacccagtatcagaatctaccactttgtgcctgagggagagggaaaagcggatacccacctgtgtcgctgtttgcgtgccaagtccaggaacagtccatacagccctgctgcatcccacgacgctgtcacaaagcaggagttcatccgaggccaagatggagaaactgaggcccagaaattgatgtccagaatgctttgctcttagccactgtactattatggcatattttatctttatgtattgcatcatttcatggattcaagtttatcaatgtcctttgacaagtttaaaaatctgtctgctaaaatctatccaatacattaaggaaaagtcccacttggcacatctcccacaccagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatca

SEQ ID NO: 187634 - DNA, 1531 bp, Homo sapiens
  Payload ID: 16932
  Gene Symbol: SFTA3
  Gene Name: surfactant associated 3
  Uniprot ID: P0C7M3
  ENST ID: ENST00000518529
  CDS Start-End: 677-961
gggagctgtgggcaggagaggaaggaaagcagctctctcagctagcgagggggtcagggactgggccaagctcagaagcggggagaagagcgagacagagatgctctgagcaggggagacagggatcccgggctgctgccgctaccaacaagggtacacactgcggtcctcaaggccaggaggggggtgggggcagggaatgcctcagccaacagggcagcggctcggccctgctgctggcccggtgggaagtagcctggggccccgcgactgaaatccgagccaggcctgggcagtctccgctagaaacgctctgggcgcgcactcctggagacgcggaggcccgggcgctccagaccagtgtccttgtaggaggcttcttcacgaagcttagagtttggcctttcatagggaaagacttgctcgggagcaagtctaagggattttaagggattttaaatcttcctgggccagggctagggagctctagtgacagtgtcttggtctggaatccaactctccaattttgaggccgcagggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtgcctgagggagagggaaaagcggatacccacctgtgtcgctgtttgcgtgccaagtccaggaacagtccatacagccctgctgcatcccacgacgctgtcacaaagcaggagttcatccgaggccaagatgttaattattcatactgcatgactgaggattttggaggcagagagagattcatctgcaatatttggaacaccaatggaggtctacgtcaacacagaatttatacagcagctggtgctagtcagagctaatgacagaatttcagtttaataaaaagacccccaactgagcacaccatcttgaaaaaagtatacttatcaaacagctttcaatcagttcaagagagacaccttaattggggagaggaagaattgcagagtagtttgtaatcatgccaattccagatcaataactgcatgtctgttctttggtagaaatagcttttgctttatattaagtaatcacatatatattctctctatttggataaggaaaccttcgctttatttgacaatgtataatgatatactcttctaattcacctctgtgtcttcacaataaacatgagtaaaatttagacaagtgatggtaaaggtcaatataattatttatttttaaaataaattttgtatctaacaggaaagcagttcttatgaaatttttatattttcaaaaattgttttgttcaaataaaattttatgagtaaagttaaa

SEQ ID NO: 187635 - DNA, 791 bp, Homo sapiens
  Payload ID: 16932
  Gene Symbol: SFTA3
  Gene Name: surfactant associated 3
  ENST ID: ENST00000518446
  CDS Start-End: 238-468
cagggactgggccaagctcagaagcggggagaagagcgagacagagatgctctgagcaggggagacagggatcccgggctgctgccgctaccaacaaggggaggaattctgagactttagaggccgcacagccttcagcgcgctcaccgcgtccaggcgtcagtgaggggctatctcgaggcgcgagtgcacaaaaggtagcgcgagtctcttctcaggcgatccagataagaggaaatgagagccgggttttctgacttccaactcattagggaccaggttctttttcttcaggatcaggcacagagactgactgaatggctccaattatcaggatttgaaaacccagtatcagaatctaccactttgtatggaggaggggaggagacgagtggggaccagcttgacatccagtcttcacctggacatatggaaagaacaaatgtgcgatctgctcgttccctctgaaggtctctgttacgtatttcctcctctcctccagagcataataaccaatgactgctctcagaaagaacaggcctgagggagagggaaaagcggatacccacctgtgtcgctgtttgcgtgccaagtccaggaacagtccatacagccctgctgcatcccacgacgctgtcacaaagcaggagttcatccgaggccaagatggagaaactgaggcccagaaattgatgtccagaatgctttgctcttagccactgtactattatggcatattttatctttatgtattgcatcatttcatggattcaagtttatcaatgtccttt

SEQ ID NO: 187636 - DNA, 2212 bp, Homo sapiens
  Payload ID: 16933
  Gene Symbol: SFTPA1
  Gene Name: surfactant protein A1
  Uniprot ID: Q8IWL2
  ENST ID: ENST00000398636
  CDS Start-End: 139-885
gacttggaggcagagacccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttc

SEQ ID NO: 187637 - DNA, 527 bp, Homo sapiens
  Payload ID: 16933
  Gene Symbol: SFTPA1
  Gene Name: surfactant protein A1
  ENST ID: ENST00000429958
  CDS Start-End: 54-527
gacccaagcagctggaggctctgtgtgtgggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagca

SEQ ID NO: 187638 - DNA, 2210 bp, Homo sapiens
  Payload ID: 16933
  Gene Symbol: SFTPA1
  Gene Name: surfactant protein A1
  Uniprot ID: Q8IWL2
  ENST ID: ENST00000419470
  CDS Start-End: 77-868
gaggcagagacccaagcagctggaggctctgtgtgtggcctggagaccccacaacctccagccggaggcctgaagcatgaggccatgccaggtgccaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccata

SEQ ID NO: 187639 - DNA, 596 bp, Homo sapiens
  Payload ID: 16933
  Gene Symbol: SFTPA1
  Gene Name: surfactant protein A1
  ENST ID: ENST00000439264
  CDS Start-End: 123-596
cccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagca

SEQ ID NO: 187640 - DNA, 2141 bp, Homo sapiens
  Payload ID: 16933
  Gene Symbol: SFTPA1
  Gene Name: surfactant protein A1
  Uniprot ID: Q8IWL2
  ENST ID: ENST00000428376
  CDS Start-End: 68-814
gacttggaggcagagacccaagcagctggaggctctgtgtgtgggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttc

SEQ ID NO: 187641 - DNA, 2189 bp, Homo sapiens
  Payload ID: 16934
  Gene Symbol: SFTPA2
  Gene Name: surfactant protein A2
  Uniprot ID: Q8IWL1
  ENST ID: ENST00000372325
  CDS Start-End: 86-832
gagacccaagcagctggaggctctgtgtgtgggtcgctgatttcttggagcctgaaaagaaggagcagcgactggacccagagccatgtggctgtgccctctggccctcaccctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataataaatcgttagtgtgttcacatgagtttccata

SEQ ID NO: 187642 - DNA, 815 bp, Homo sapiens
  Payload ID: 16934
  Gene Symbol: SFTPA2
  Gene Name: surfactant protein A2
  Uniprot ID: Q8IWL1
  ENST ID: ENST00000372327
  CDS Start-End: 47-793
gcagctggaggctctgtgtgtgggagcagcgactggacccagagccatgtggctgtgccctctggccctcaccctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggaca

SEQ ID NO: 187643 - DNA, 726 bp, Homo sapiens
  Payload ID: 16934
  Gene Symbol: SFTPA2
  Gene Name: surfactant protein A2
  ENST ID: ENST00000417041
  CDS Start-End: 253-726
cagagacccaagcagctggaggctctgtgtgtggatccatccctaccagggactcagcagggcctaagcagggggagtgggagaacagaccccaagaggaaggaagacctcatcactgactgtgagagggtcatcaccccccgatgatcaccttgaagggtccaggctgtgggccctattcatctcttttcattctcaggtcgctgatttcttggagcctgaaaagaaggagcagcgactggacccagagccatgtggctgtgccctctggccctcaccctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagca

SEQ ID NO: 187644 - DNA, 644 bp, Homo sapiens
  Payload ID: 16934
  Gene Symbol: SFTPA2
  Gene Name: surfactant protein A2
  ENST ID: ENST00000492049
  CDS Start-End: 352-644
gccagtttcccagggtaacatagtgaggcactgaaagaaaggagactgcactggagcccaggtccctgggctccccagagctccttactcttcctcctcctcagcagtcttgagaccccacaacctccagccggaggcctgaagcatgaggccatgccaggtgccaggtgatgcttggaattttcccgggtgcttcgggtcttcccagcactctggtctcgcccgccctgcctctcgggctctgcccagcttcctgagtcctgacagagcacagtgggggagatgttggcagaggtggcagatgggctcacggccatccctccggcaggagcagcgactggacccagagccatgtggctgtgccctctggccctcaccctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagg

SEQ ID NO: 187645 - DNA, 3666 bp, Homo sapiens
  Payload ID: 16935
  Gene Symbol: SFTPB
  Gene Name: surfactant protein B
  Uniprot ID: P07988
  ENST ID: ENST00000393822
  CDS Start-End: 137-1282
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgag

SEQ ID NO: 187646 - DNA, 1867 bp, Homo sapiens
  Payload ID: 16935
  Gene Symbol: SFTPB
  Gene Name: surfactant protein B
  ENST ID: ENST00000409383
  CDS Start-End: 101-1282
tgtaaatgctcttctgactaatgcaaaccatgtgtccatagaaccagaagatttttccaggggaaaagagcccccacgccccgcccagctataaggggccatgcaccaagcagggtacccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaa

SEQ ID NO: 187647 - DNA, 1743 bp, Homo sapiens
  Payload ID: 16935
  Gene Symbol: SFTPB
  Gene Name: surfactant protein B
  ENST ID: ENST00000428225
  CDS Start-End: 1-1123
acacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaagagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaa

SEQ ID NO: 187648 - DNA, 3554 bp, Homo sapiens
  Payload ID: 16935
  Gene Symbol: SFTPB
  Gene Name: surfactant protein B
  Uniprot ID: P07988
  ENST ID: ENST00000519937
  CDS Start-End: 21-1166
acccaggctgcagaggtgccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgagaaagaaaaagacaccgtcctttaaagtgctgcagtatggccagacgtggtggctcacacctgcaatcccagcaccttaggaggccgaggcaggaggatccttgaggtcaggagttcgagaccagcctcgccaacatggtgaaaccccatttctactaaaaatacaaaaaattagccaagtgtggtggcatatgcctgtaatcccaactactcagaaggccgaggcaggagaattacttgaacgcaggagaatcactgcagcccaggaggcagaggttgcagtgagccgagattgcaccactgcactccagcctgggtgacagagcaagactccatctcagtaaataaataaataaataaaaagcgctgcagtagctgtggcctcaccctgaagtcagcgggcccaggcctacctcactctctcccttggcagagaagcagacgtccatagctcctctccctcacaagcgctcccagcctgccctccagctgctgctctcccctcccagtctctactcactgggatgaggttaggtcatgaggacaccaaaaacctaaaaataaacaaaaagccaaacaagccttagcttttcttaaagactgaaatgcctggaagtgtccctttatttataaaataacttttgtcatatttcttatacatgtttcttgtaagaaattcagaaactacagacaaagagagtggaaattacccactgtcaggcctctgagcccaagctaagccatcatatcccctgtgccctgcacgtatacacccagatggcctgaagcaactgaagatccacaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccacccaccccacgcccgcacccccgcacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaaagcctgtttggtagtctcttcacagggaagcatgtgacacccacaatcccacctagcccaggagagagctacggcagggtgtgtgttttgacactgagcttggggctttttccatcttctccccacagcctctggctccacacctccaccgttcaagcgccagaaagagctgtctatgcagcctgctcttgggcctggggatgagacacacaattcattggctcctggattttaagtagacatttgtaaatctatagctaactactgtccttaaagccattgtttccattacaaaatccaactctctgagagaaaagggtgttttaaatttaaaaaaataaaaacaaaaaagtttgattgagacaa

SEQ ID NO: 187649 - DNA, 532 bp, Homo sapiens
  Payload ID: 16935
  Gene Symbol: SFTPB
  Gene Name: surfactant protein B
  ENST ID: ENST00000494165
  CDS Start-End: 1-277
agaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccaggtgagtccaggcccccagttgcggggaggtaagggggcaggtcctgaccatcagggcatgggaggcccttctgctccccaagcaggaagaggcggccactcctgccggctgctccatcctccctctcaccgcacagctggaggctcctgagggcttctggctggccatcaggaaaacaccctttccggaccccgagcactgccccgcccagaaccccagtcactgagtgcccaacc

SEQ ID NO: 187650 - DNA, 997 bp, Homo sapiens
  Payload ID: 16936
  Gene Symbol: SFTPC
  Gene Name: surfactant protein C
  Uniprot ID: P11686
  ENST ID: ENST00000318561
  CDS Start-End: 175-768
cttatctgggcttcggttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagc

SEQ ID NO: 187651 - DNA, 773 bp, Homo sapiens
  Payload ID: 16936
  Gene Symbol: SFTPC
  Gene Name: surfactant protein C
  ENST ID: ENST00000437090
  CDS Start-End: 32-517
gaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagcacagcccctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggccc

SEQ ID NO: 187652 - DNA, 921 bp, Homo sapiens
  Payload ID: 16936
  Gene Symbol: SFTPC
  Gene Name: surfactant protein C
  ENST ID: ENST00000522109
  CDS Start-End: 25-477
ggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccaggtgtgtgtgtgtgggtgaaaagagtgggctgtctccctcccagggctgctgggaggagtgtccgaatggtggctatttgtcacctgtaaagcactgttcctcattggctgccagctgactgcccctctcctattcccctgcacgactcctttccttcccaccccactgccaagctgctgggctcagctgagtccactcactacctggtggcttctgactctagcacagcccctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcacc

SEQ ID NO: 187653 - DNA, 681 bp, Homo sapiens
  Payload ID: 16936
  Gene Symbol: SFTPC
  Gene Name: surfactant protein C
  ENST ID: ENST00000524255
  CDS Start-End: 23-457
agagcatagcacctgcagcaagatggatgtgggcagcaaagaggtcctgatggagagcccgccggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccgggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaa

SEQ ID NO: 187654 - DNA, 395 bp, Homo sapiens
  Payload ID: 16936
  Gene Symbol: SFTPC
  Gene Name: surfactant protein C
  ENST ID: ENST00000523296
  CDS Start-End: 22-395
gagcatagcacctgcagcaagatggatgtgggcagcaaagaggtcctgatggagagcccgccggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccaggccaagcccgcagtgcctacgtctaagctgggccaggcagaggggcgagatgcaggctcagcaccctccggaggggacccggccttcctgggcatggc

SEQ ID NO: 187655 - DNA, 519 bp, Homo sapiens
  Payload ID: 16936
  Gene Symbol: SFTPC
  Gene Name: surfactant protein C
  ENST ID: ENST00000520605
  CDS Start-End: 30-497
ggagaggagagcatagcacctgcagcaagatggatgtgggcagcaaagaggtcctgatggagagcccgccggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaa

SEQ ID NO: 187656 - DNA, 1046 bp, Homo sapiens
  Payload ID: 16936
  Gene Symbol: SFTPC
  Gene Name: surfactant protein C
  ENST ID: ENST00000521315
  CDS Start-End: 33-608
ggaggagaggagagcatagcacctgcagcaagatggatgtgggcagcaaagaggtcctgatggagagcccgccggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggttctggagatgagcattggggcgccggaagcccagcaacgcctggccctgagtgagcacctggttaccactgccaccttctccatcggctccactggcctcgtggtgtatgactaccagcagctgctgatcgcctacaagccagcccctggcacctgctgctacatcatgaagatagctccagagagcatccccagtcttgaggctctcactagaaaagtccacaacttccaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaa

SEQ ID NO: 187657 - DNA, 1281 bp, Homo sapiens
  Payload ID: 16937
  Gene Symbol: SFTPD
  Gene Name: surfactant protein D
  Uniprot ID: P35247
  ENST ID: ENST00000372292
  CDS Start-End: 42-1169
tttgcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaagggggacaaaggcattcctggagacaaaggagcaaagggagaaagtgggcttccagatgttgcttctctgaggcagcaggttgaggccttacagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgctgccaatatcctaataaaaaggtgaccatctgtgccgggaa

SEQ ID NO: 187658 - DNA, 659 bp, Homo sapiens
  Payload ID: 16937
  Gene Symbol: SFTPD
  Gene Name: surfactant protein D
  ENST ID: ENST00000444384
  CDS Start-End: 5-659
agacatgtttctcagcacctccaaacatgggcggcaagaggccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaaggggg

SEQ ID NO: 187659 - DNA, 1093 bp, Homo sapiens
  Payload ID: 16938
  Gene Symbol: SURF1
  Gene Name: surfeit 1
  Uniprot ID: Q15526
  ENST ID: ENST00000371974
  CDS Start-End: 33-935
gcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaatgagctcatgactggttcatcataaaatcctggcttggtttcagtccaaagaa

SEQ ID NO: 187660 - DNA, 991 bp, Homo sapiens
  Payload ID: 16938
  Gene Symbol: SURF1
  Gene Name: surfeit 1
  ENST ID: ENST00000615505
  CDS Start-End: 308-883
gcgtcccggaagcgcccgcggggccgggtgcgatggcggcggtggctgcgttgcagctggggctgcgggcggcggggctgggacgggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctaccttaaatga

SEQ ID NO: 187661 - DNA, 991 bp, Homo sapiens; identical to SEQ ID NO: 187660
  Payload ID: 16938
  Gene Symbol: SURF1
  Gene Name: Surfeit 1
  ENST ID: ENST00000628258
  CDS Start-End: 308-883

SEQ ID NO: 187662 - DNA, 1093 bp, Homo sapiens; identical to SEQ ID NO: 187659
  Payload ID: 16938
  Gene Symbol: SURF1
  Gene Name: Surfeit 1
  ENST ID: ENST00000626663
  CDS Start-End: 33-935

SEQ ID NO: 187663 - DNA, 842 bp, Homo sapiens
  Payload ID: 16939
  Gene Symbol: SURF2
  Gene Name: surfeit 2
  Uniprot ID: Q15527
  ENST ID: ENST00000371964
  CDS Start-End: 42-812
gcgagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagggcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaagtttcgagaaa

SEQ ID NO: 187664 - DNA, 842 bp, Homo sapiens; identical to SEQ ID NO: 187663
  Payload ID: 16939
  Gene Symbol: SURF2
  Gene Name: Surfeit 2
  ENST ID: ENST00000630633
  CDS Start-End: 42-812

SEQ ID NO: 187665 - DNA, 2984 bp, Homo sapiens; identical to SEQ ID NO: 141364
  Payload ID: 16940
  Gene Symbol: SURF4
  Gene Name: surfeit 4
  Uniprot ID: O15260
  ENST ID: ENST00000371989
  CDS Start-End: 131-940

SEQ ID NO: 187666 - DNA, 715 bp, Homo sapiens; identical to SEQ ID NO: 141367
  Payload ID: 16940
  Gene Symbol: SURF4
  Gene Name: surfeit 4
  ENST ID: ENST00000371991
  CDS Start-End: 75-635

SEQ ID NO: 187667 - DNA, 1206 bp, Homo sapiens; identical to SEQ ID NO: 141368
  Payload ID: 16940
  Gene Symbol: SURF4
  Gene Name: surfeit 4
  Uniprot ID: O15260
  ENST ID: ENST00000485435
  CDS Start-End: 131-610

SEQ ID NO: 187668 - DNA, 2863 bp, Homo sapiens; identical to SEQ ID NO: 141366
  Payload ID: 16940
  Gene Symbol: SURF4
  Gene Name: surfeit 4
  Uniprot ID: O15260
  ENST ID: ENST00000545297
  CDS Start-End: 198-584

SEQ ID NO: 187669 - DNA, 3148 bp, Homo sapiens; identical to SEQ ID NO: 141363
  Payload ID: 16940
  Gene Symbol: SURF4
  Gene Name: surfeit 4
  ENST ID: ENST00000613129
  CDS Start-End: 425-1105

SEQ ID NO: 187670 - DNA, 3200 bp, Homo sapiens; identical to SEQ ID NO: 141365
  Payload ID: 16940
  Gene Symbol: SURF4
  Gene Name: surfeit 4
  ENST ID: ENST00000618229
  CDS Start-End: 477-1157

SEQ ID NO: 187671 - DNA, 4447 bp, Homo sapiens
  Payload ID: 16941
  Gene Symbol: SURF6
  Gene Name: surfeit 6
  Uniprot ID: O75683
  ENST ID: ENST00000372022
  CDS Start-End: 267-1352
gggtgatagaggcactgaggccaggccccgggggtgccctgctgcaccgactccgggcggagattggctgtcctcggcccgcaatgctgtgcgccccgccccgcgcgccgcttccggcggagtcaggcttggctaatcgagcgcgcgggctggcggctcggcgttcgtttggccgcgcctgcccgtgtggtggtttccggcggaggtggtgagagtcgcacgcgcagcggggaaggtgtgagtcgtgaacggcccgggtctccgccatggcctctctactcgccaaggacgcctacctgcagagcctggccaagaagatctgctcccattcggccccggaacagcaggcgcgcacgcgggctggcaaaactcaaggctcagaaactgcagggcccccaaaaaagaaaaggaagaaaacacaaaagaaattccggaagcgagaagagaaggctgctgagcacaaggccaagtccttgggggagaaatctccagcagcctctggggccaggaggcctgaggcagccaaagaggaagcagcttgggcttccagctcagcagggaaccctgcagatggcctggccactgagcctgagtctgtctttgctctggatgttctgcgacagcgactgcatgagaagatccaggaggcccggggccagggcagtgccaaggagctgtcccctgccgccttggagaaaaggcggcggagaaagcaggaacgggaccggaagaagaggaagcgaaaggagctgcgggcgaaagagaaggccaggaaggctgaggaggccacggaggcccaggaggtggtggaggcaaccccagagggggcctgcacggagccgcgggagccgcccgggctgatcttcaataaggtggaggtgagcgaagacgagccggccagcaaggcgcagcgcagaaaagagaagaggcagagggtgaaggggaacctcacgccgctgaccgggaggaactaccggcagctgctggagcgcctgcaggcacggcagagccggctggacgagctgcgcggccaggatgaggggaaggcgcaggagctggaggcgaagatgaagtggaccaacctcctctacaaggcggagggcgtgaagatccgtgacgacgaacgcctgctgcaggaggccctgaagcgcaaggagaagcgcagggcgcagcggcagcgccggtgggagaagcgcacggccggcgtggtggagaagatgcagcagcgccaggaccggcggcggcagaacctgcgcaggaagaaggcggcccgcgccgagcgccgcctgctcagagcccgcaagaagggccgcatcctgccgcaggacctggagcgcgcaggcctggtctgagtctttcccacctggggccgccgtcttccgtcctaggagactccaggacaccctctgagtccttgacgctggctctgtcccaggatctccacagacctcggcctctccatgtgagggggacacagtggtgctctgctgagttgtgagggcccagatcacagatcccatgtgagaaagagagagtttcagcgtcatccttgaacgcaggatccgggaccttcagacccagggaaagggtgagggagactggggcctggtctgctttcccgggcctgaaagcttccccgaggtttgcagggtcagggaggaggaacggtgggggtgggcagtcactgcctgttccccactgcctgtgttcgcaggagccacgggacagaagacggtggcctctgctgccgggccacgttagtccgcagctcacccgaacagaggacaaccctgaggtgtggcatatgggcacctggcactgggagtcgggggagcacgtccaggcgtggtgcatcctggggcagaacgccatggctcctccccgctctcttggcttctgcctgttggggtctcattcctttctgttccccagtgccccggggcggcattttactgctcagaatttggagggagggagcagtaccttcccggagtccacgcatgtgagttgggtcaagtgcattggacctagggaaagagaaagaaagaataaaagctggagagagagtgaagtgaatgcaagatacaaagtgggatggaagaattaaatccagagttccaggcaatcaaaatgagtgcaggttgaaagaaaacaggtgaattttagtggcatatggatgataaagctgtaaataaaattcttttgatgaaactctccggttatgagacaaagactgtaactgaacaggagctggtgtgactgttaccagacagaggcaactgatgaaaaagccctgtgaaagataggatgtgaggtgagcatgagcttgagctgagagacagacacaacagtatctgaaaagaatacatactctttccatgcatatatggaacatggatggaaactgaccacctactttgtccagaaaagaagtcttaagatatttcaaggaatcagtgtcgttatctgaccgtatcccaatgtcattaaaaaaaatttgagctatttttttttgttttttagatagagtcttgctctgtcactcaggctggagtgcagtggcatttcatatttggaatttttaaaacacacttataaattacctatgagttaaagaattccgaatggctattagaaatatttgggactaaaggataatgaaaatgctacgtattaaaatttgtggaacagggcctggcatggtggctcatgctgtcaatcccagctctttgggaggcgggtggatcacttgagatcaggagttcaaggctagcctggacaacatgataaaaccccatctctattaaaaataaaaaattagctgggtgtggtggtgcaaacctgtagtcccagctgcttgggaggctgaggcgggagaatcacttgaacccaggaggtagaggctgcagtgagccaagatcgagccgctgcactccagcctgggtgacagagcaagactgtctcaaaaagaaaaaatttaagatttgtggaacagagctaaagcagcacaaaaaaacatagcccctaaatgtatgtgcatctacagataaatagtgccatttatacacacatacgctgtatgtctgtatttttaaagctaaagaaaaataagcatgcagcttaagttggaacaactcaaagtaaatggaagaaaaatctccaaaactgactaaaagtaatagaaagcctgagttgtaatcactgatgaaattgagtcagtagttaagaatgttcccctagacggttttacagggaagttccacgatatagagaacaggtaattccagacgtagacaaattctaacagaatcaattgagagaacacttcattcgtgaacttagctttgataccaaaactaggtaagagaaagggaagttaccaaatacctgtgggcggcaagccacccaggcgccgaggcaagagacagaggacacgagctgttccagtataataaaatataaaacaagaatagttacagcagatatagatcttagatatgattacatatgaatatcattaatcattagtttgtagcaattaccttttattccaatattataataatcctcgctctataatcatagcctaggaaaaaccaggccatacagagataggagctgaggggacataggtgtgaccagaagacaagagtgcgagccttctgttatgcccggacagggccaccagagggctccttggtctagcggtgacgccagcgtctgggaagacgcccgttgccaggtggaccatggtctagcagtagcaaaaagtatcaaggaacaacacccgctacttagcagaccgggaaagggagtgtccctttccctggaggagtttagagaagactctgctcttccacctcttgtggagggcctgacatccggcaggcctgcccgcagttatctggaggcctaaccgtctccctgtgatgctgtgcttcagtggtcacgctcctagtccgccttcatgttccatcctgtacacctggctctgccttctagatagcagtagtaaattagtgaaagtactaaaagtctctgatatgcagaagtaatggcataagctgtctttctctctgtctcctctctctctctgcctcggctgccaggcagggaagggcaccctgtccagtggacacgtgatccacgtgaccttacctatcattggagatgactcacactctttaccctgccccttttgctttgtatccaataaataacaatgcagccagacattcggggccactaccggtctccgagcattggtagtagtggtctcccgggcccagctgccttttcttttatctctttgtcttgtgtgtgtatttctacactctctcattgctgcacacagggagggagagacccacggaccctgtggggctggtccctacaaataccaatgtcaagattttagacaataataaaccaagtttagcaaagtgcc

SEQ ID NO: 187672 - DNA, 4447 bp, Homo sapiens; identical to SEQ ID NO: 187671
  Payload ID: 16942
  Gene Symbol:
  Gene Name: Surfeit locus protein 6  [Source:UniProtKB/Swiss-Prot
  Acc:O75683]
  Uniprot ID: O75683
  ENST ID: ENST00000629980
  CDS Start-End: 267-1352

SEQ ID NO: 187673 - DNA, 2423 bp, Homo sapiens
  Payload ID: 16943
  Gene Symbol: SUGP1
  Gene Name: SURP and G patch domain containing 1
  Uniprot ID: Q8IWZ8
  ENST ID: ENST00000247001
  CDS Start-End: 349-2286
aacaagccgccgccacagggaggcggaagcaggcgcgcgagacggggccgggctctcctcgcggcttccgcgagatctgccgcccaaagcatcctggaacatgtagtttgtatttgggatgactgccgctccgggaaggtgtaaaagggcgacgccgtttggttatcgtgactgggacttaggcatcgctgataggctgaggcttccgtttctggaggttaaaaaaaaaaaaacccagtcgttcacgcagtaatagggcgagtctgaccgaggcggactacatctcccatcaggcgatgcacactataacagggccccttaaggggcgccggagcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaca

SEQ ID NO: 187674 - DNA, 1094 bp, Homo sapiens
  Payload ID: 16943
  Gene Symbol: SUGP1
  Gene Name: SURP and G patch domain containing 1
  ENST ID: ENST00000535070
  CDS Start-End: 14-571
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcaggtgcctcatggagaaagtctctagcacttgcccagttgcctttgggacacacagcagcccttggccgggggcaagtcaggctctcaagtggaaattcacagtactgttcagtttatgttgtgtacgttctcagggtctcccctttatgatgagggaaatggcagggaatggggaactttaggatctgtggagggggaacacccagcctgtgtgcgagttccacagaagggtgggtgtgtgacaagcagcctagcctccctgccatccccggccatgcggtcgtaccctagccccagtggctgggtctgtgttcactggctcatccattcattgggtgggtttggcacttgctctgtgccc

SEQ ID NO: 187675 - DNA, 2282 bp, Homo sapiens
  Payload ID: 16943
  Gene Symbol: SUGP1
  Gene Name: SURP and G patch domain containing 1
  Uniprot ID: Q8IWZ8
  ENST ID: ENST00000588731
  CDS Start-End: 14-682
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtgtgtctcaccaagacagtgagaccgactcccccctcgtcatggtgttttgtgcctggactcgggacgcccgacagcctcctgcatctcacactcttctccccccaccccctctgtcgttgtggtccatagagagagtgtgcctattgactgtggggtgtgtgagttgaaccccagtactgacagcctccttaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacca

SEQ ID NO: 187676 - DNA, 2177 bp, Homo sapiens
  Payload ID: 16943
  Gene Symbol: SUGP1
  Gene Name: SURP and G patch domain containing 1
  ENST ID: ENST00000587119
  CDS Start-End: 14-403
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtgtgtctcaccaagacagtgagaccgactcccccctcgtcatggtgttttgtgcctggactcgggacgcccgacagcctcctgcatctcacactcttctccccccaccccctctgtcgttgtggtccatagagagagtgtgcctattgactgtggggtgtgtgagttgaaccccagtactgacagcctccttaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 187677 - DNA, 2066 bp, Homo sapiens
  Payload ID: 16943
  Gene Symbol: SUGP1
  Gene Name: SURP and G patch domain containing 1
  ENST ID: ENST00000589144
  CDS Start-End: 1-235
cgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagaaattaggctgttgggtgtggtgagttgagcccagtactgacagcctgcttaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccacagatgcctggtcctgttgcaggaagcccctcctgttagcagcgggatgcaagatgctgtctcggggctctccttattggcctgtggagtctccatccccgctcagcctgggttgcactggaggggaggaagaaagttgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaaggaa

SEQ ID NO: 187678 - DNA, 601 bp, Homo sapiens
  Payload ID: 16943
  Gene Symbol: SUGP1
  Gene Name: SURP and G patch domain containing 1
  ENST ID: ENST00000591350
  CDS Start-End: 14-124
attgtgggattggatgagtctcaagatggacaaccgggatgttgcagaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcaga

SEQ ID NO: 187679 - DNA, 532 bp, Homo sapiens
  Payload ID: 16943
  Gene Symbol: SUGP1
  Gene Name: SURP and G patch domain containing 1
  ENST ID: ENST00000585444
  CDS Start-End: 14-223
attgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgagtaagtgcctgctggggcctggatggggcctggatgtgagtctttgagggtcaccagcacagggtttggcttgtgagggcagtcagcatgtgcttgcacccagccatagcctgatgatccaaggaatgacccagatgcccttgggaggctcactgtggcaagagagaaatgagggaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccag

SEQ ID NO: 187680 - DNA, 764 bp, Homo sapiens
  Payload ID: 16943
  Gene Symbol: SUGP1
  Gene Name: SURP and G patch domain containing 1
  ENST ID: ENST00000590439
  CDS Start-End: 39-764
attgtgggattggatgagtctcaagatggacaaccgggatgttgcaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcata

SEQ ID NO: 187681 - DNA, 3629 bp, Homo sapiens
  Payload ID: 16944
  Gene Symbol: SUGP2
  Gene Name: SURP and G patch domain containing 2
  Uniprot ID: Q8IX01
  ENST ID: ENST00000330854
  CDS Start-End: 66-3158
gggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatgttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 187682 - DNA, 3640 bp, Homo sapiens
  Payload ID: 16944
  Gene Symbol: SUGP2
  Gene Name: SURP and G patch domain containing 2
  Uniprot ID: Q8IX01
  ENST ID: ENST00000337018
  CDS Start-End: 135-3383
ctgcgcggcgcggcgctgcggagaccgttggttcatttgcatgtccccgcctcgcgcggcggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgca

SEQ ID NO: 187683 - DNA, 6176 bp, Homo sapiens
  Payload ID: 16944
  Gene Symbol: SUGP2
  Gene Name: SURP and G patch domain containing 2
  Uniprot ID: Q8IX01
  ENST ID: ENST00000452918
  CDS Start-End: 75-3323
ggcggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactccatctccaaaaaaaaaaaaaaaaaaggccggcacggtgactcacgcctataattccagcactttgggaggccgaggcaggtggatcacgaggtcaagagatcgagaccatcctggccaacatggtgaaaccctgtctctactaaaaatgcaaaaaattagctgggcgtggtggcgggcgcttgtagtcccagctactcaggaggctgaggcaggagaatcacttgaacccgggaggcggaggttgcagtgagccgagattgtgccaccgcactccagcctggcaacagagcgagactctgtctcaaaaaaaaaaaaggaaatcctggctttctttaagccacagacttcctaggctgtggtcccagctccttgtctgcctggtccctgtcaccttgcagtgccaccacccccaggggctctgcttgcttccagtggcttctgtagctttggcaactggcagatctttatggcagtagaggtgccagcatggaggatggagtttgggtttataacccaaccctcgaacgaaccagcctgtgggggcctggagtggagctggttttggggagtcacaggtgcggggggttcatcttctcctttctccttctcctttcctgacccctccgacagcttccatgttggccatgggtcaggtgaatggatggagctccaagcggggctcagcccattgacccgagcgaggcgcacacacctgcagcgtggatcaagcgcactctctccagcatcgccctgaccattccatgtgctttgtcctagcatgttcattcttgactttctccacttcattttattaaaaagttaaatgctttaggaatctgtggcgtgtggccactgaccgccccccacctcctgccgctcctccaagtttgagctgagatggttctgtgagtccttggcaggggtcaaagggcacatctccttgaacctagaaagccccctacactctcagaggacacctctcctgtggattcagcgctggggcagtgaaggtgtcgggagccagcagagcatggtgcgtgctgccagctgccggccagccgggatagaggagatgccactggccctccgtgcccccagcccctccctcttaaccgaggctgtccttgctctctgcagaggccgctctgcaggatcctcgtgtcgcgcgtgatgtgtggtggcacagccgtgtcaaagtcacagtgtcttttctgtcgttctagttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgcagtgtg

SEQ ID NO: 187684 - DNA, 4169 bp, Homo sapiens
  Payload ID: 16944
  Gene Symbol: SUGP2
  Gene Name: SURP and G patch domain containing 2
  Uniprot ID: Q8IX01
  ENST ID: ENST00000594773
  CDS Start-End: 67-3189
ggcctcccagagactcgcggacgctcacgataaccaaggacgaccgcgaaccaagggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaattccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgcagtg

SEQ ID NO: 187685 - DNA, 732 bp, Homo sapiens
  Payload ID: 16944
  Gene Symbol: SUGP2
  Gene Name: SURP and G patch domain containing 2
  ENST ID: ENST00000594445
  CDS Start-End: 399-732
gaggcccgggccctggcgtcgtcggtgggtggctcccggggtgggaagctcgggctcggccttgggggcccgccccgggctccgtgatggcgtcgcaggctcggccctctggctgcggcggcggccgcgtccccgccgggttggcctgggtggccggctgcggcctcccgggcccggcgcccccatttcctcgcccgcagaggccgggagacggcgggccgcgtccacaaaggctcattggttcagtcgttcattcattcctcccgaactcggagcggcccccgctcgggaggagataacggcgcccagcgctgcatcgggcccttgccctctttagaaccggttcagcccccacaccagcccctttactggctgcccattccatagggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctgg

SEQ ID NO: 187686 - DNA, 747 bp, Homo sapiens
  Payload ID: 16944
  Gene Symbol: SUGP2
  Gene Name: SURP and G patch domain containing 2
  ENST ID: ENST00000593795
  CDS Start-End: 1-161
tccatgaaccagttcgaattgcctatgacaggcctcggggtcgtcccatgtccaaaaagaagggcccaggtcgtgcacagctcccagaagggcctgacggatgccccgtttctcatctcagccgaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttgttccagggtcacccccgagaggacaacaggcatctggaagtgctctctcgccactctgggtgctttactgtctctggcttgtttccatcactggaaatcacttagagaattgtagtgtttttggtccttgataaagcctagaagacatttgtgatgttacaaaatggaagttttcttttgtttctgttttttaagatctaagaagttgtgaatgttgttaatcatttagccgttgcaataaatgtagaggaaatgcagtgtg

SEQ ID NO: 187687 - DNA, 3235 bp, Homo sapiens
  Payload ID: 16944
  Gene Symbol: SUGP2
  Gene Name: SURP and G patch domain containing 2
  ENST ID: ENST00000598240
  CDS Start-End: 1-511
attacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttgatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctca

SEQ ID NO: 187688 - DNA, 5546 bp, Homo sapiens
  Payload ID: 16944
  Gene Symbol: SUGP2
  Gene Name: SURP and G patch domain containing 2
  Uniprot ID: Q8IX01
  ENST ID: ENST00000601879
  CDS Start-End: 299-3547
aaccacgtacccgagggtcgcgccagcccgaccctgcggcacccccactccccactccgcgcgggacaggcctcggcagccgcagcgtctcacccggtcttcgcggccacgtggggaaaggtggggcgcgcggttgtcacccagggagccgcctctagccccttccggccgccgtacgcgcgcaggcgctgtggcgcccctaggcttggcctcccagagactcgcggacgctcacgataaccaaggacgaccgcgaaccaagtgtatttttttctctctcaccatagggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaataggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactccatctcc

SEQ ID NO: 187689 - DNA, 814 bp, Homo sapiens
  Payload ID: 16944
  Gene Symbol: SUGP2
  Gene Name: SURP and G patch domain containing 2
  ENST ID: ENST00000597280
  CDS Start-End: 1-197
cctcaggtacctgcttccctcggaagaggatcagcagcaagtcattgaaggttggcatgattccagctcccaagagagtgtgtctcatccaggagccaaaagaggcgagaacccaccagtacagcagagctgaagcctgttcccagaacgggtctcttgtcccattgcagtcccctgcccgattcagcaaccactgactgttttccaagccccagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaagg

SEQ ID NO: 187690 - DNA, 4752 bp, Homo sapiens
  Payload ID: 16944
  Gene Symbol: SUGP2
  Gene Name: SURP and G patch domain containing 2
  ENST ID: ENST00000600377
  CDS Start-End: 21-3311
gagaccgttggttcatttgcatgtccccgcctcgcgcggcggcggcggcggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgggaaccccctcggaaggggaagggttgggtgctgacgggcaggagcacaaagaagacacattcgatgtgttccgacagaggatgatgcagatgtacagacacaagcgggccaacaaataggtatgttcacaggccagtgtgtaaggccgtctgccctcgctggcgtgctggtatgcagagaaatttcccccaacaaagttgatgttccctgctcccccaaaaatgccacacacaaaaaaaatcacaaaattctgtgagggaaacaaaagggtctatggatgtggatatgccccattcttaccttccaggtttgctgaaggagcaaacctcacactggccaagggcagatgcgcatggcctgcctggtgccccggctgtgagcccctcaaggcctccaggccagcctccgtggatgtgcgtgtggaaataggccacgcctgtctcttctcttgctcaagttttctctcacagatgacagccacctaccacataacatgaccagcaaacggactgttcctagtccagagggccttgccatcatgcaagtggaagggcgactgtgacagccactgccacagaggatggcagttggctgtgtccctttgtgagggtcttcaaatccttttccttctgcagggccttgggcctgtaaatatcctcatctttctattcttttttttttttagttgccccctcacctaatttccacctcagttttgaacaaaatcgttctcttcctgaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctg

SEQ ID NO: 187691 - DNA, 5565 bp, Homo sapiens
  Payload ID: 16944
  Gene Symbol: SUGP2
  Gene Name: SURP and G patch domain containing 2
  ENST ID: ENST00000600239
  CDS Start-End: 72-2597
ggcggcgggtgaggagcctgaggcggcggcgggggtggctccgcgcgcggtggtctcgggggcaaaataacatggcagccagacgaattacacaggagacttttgatgctgtattacaagaaaaagccaaacgatatcacatggatgccagtggtgaggctgtaagcgaaactcttcagtttaaagctcaagatctcttaagggcagtcccaagatccagagcagagatgtatgatgacgtccacagcgatggcagatactccctcagtggatctgtagctcactctagagatgccggaagagaaggcctgagaagtgacgtatttccagggccttccttcagatcaagcaacccttccatcagtgatgacagctactttcgcaaagaatgtggccgggatctggaattttctcactctgattctcgggaccaggtcattggccaccggaaattggggcatttccgttctcaggactggaaatttgcgctccgtggttcttgggaacaagactttggccatccagtttctcaagagtcctcttggtcacaggagtatagttttggtccctctgcagttttgggggactttggatcttccaggctgattgagaaagagtgtttggagaaggagagtcgggattatgacgtggaccatcctggggaggctgactctgtgcttaggggcggcagtcaagtccaggccagaggtcgagctctaaacatcgttgaccaggaaggttccctcctaggaaagggggagactcagggcctgctcacagctaaggggggtgttgggaaacttgtcacattgagaaatgtgagcacaaaaaaaatacccaccgtgaatcgtattactcccaaaactcagggcactaaccaaatccagaaaaacactccaagtcctgatgtgaccctggggacaaacccagggacagaagatatccagttccccattcagaagatccctctggggctggatctgaagaatcttcggctccccagaagaaagatgagctttgacatcatagataagtctgatgttttttcaagatttgggatagaaataatcaaatgggcaggattccacaccataaaagatgatattaaattttcccaacttttccagactctctttgaacttgaaacagaaacctgtgctaaaatgcttgcctcattcaaatgttccttaaaaccagagcacagagatttttgcttttttactatcaaatttttaaagcactctgctttgaaaacacccagagttgataatgagtttttaaacatgcttttagacaaaggtgctgtgaagaccaaaaattgcttttttgaaatcataaagccttttgacaagtacataatgagacttcaagaccggcttctgaagagtgtcacacctttgcttatggcctgcaatgcctacgagctaagtgtcaagatgaagaccctcagtaaccccctggacttggctcttgccctagaaaccaccaactctctctgccggaagtctttggcccttttgggacagacattttccttggcctcttctttccggcaggagaaaatcttagaagctgtcggcctgcaagatatagctccctcacctgctgcgtttccaaacttcgaagactccactttgtttgggcgagagtacatagaccacctgaaggcctggctagtcagcagcggatgtcccctccaggttaagaaagccgaaccagagccgatgcgagaggaggagaaaatgattcctcctacgaaacctgaaattcaggccaaggctccaagtagtctgagtgatgctgtcccccagcgagcagatcacagggtagtgggcaccatcgaccagcttgtgaaacgtgtcatcgaaggcagcctgtctcccaaagagagaactcttctcaaagaggaccctgcttactggtttttgtctgatgaaaatagtctggagtataaatattacaagctgaagttggcagaaatgcagcggatgagcgagaacttgcgaggagccgaccagaagccgacctcagcagactgtgcagtgagggccatgctgtactcccgggctgtccgcaacctcaagaagaaactccttccgtggcagcggcgggggctcctccgtgctcaagggctccggggctggaaggcgaggagagcgaccaccgggacccagaccctcctatcctcaggcaccaggctgaaacaccacggccggcaggctccaggcctctcacaggcaaaaccatccctgccagacagaaatgatgctgccaaggactgcccgccagacccagttggaccttctcctcaggaccccagcttagaagcctcaggcccatcccccaagccagcaggagtggacatctctgaagcacctcagacctcttctccctgcccatctgctgacattgacatgaagacaatggagactgcagagaaactggctagatttgttgctcaggtgggaccagagatcgaacaattcagcatagaaaacagcaccgataaccctgacctgtggggacctgccttcatctcgggcatcaggaaaaacctccccagagggacatttaatctgcatccaaaggctaaataggagttggccaggggaggggagagaggtttctacatgaccaaaatagttctgctttcaaattctatcgaaagaaagtgtttgaactatgtccatcaatttgtttcacgtcatctccgcacaaccttcacactggtggtggtgacaccacgggttctcaggagagccccgtggacctcatggaaggggaagcagagtttgaagacgagccccctccgcgggaggctgagctggagagcccagaggtgatgcctgaggaggaggacgaggacgatgaggatgggggagaggaggcccccgctcctggaggggcgggcaagtctgagggcagcacccctgccgacggccttcccggcgaggctgccgaggacgacctggctggagcacctgccttgtcacaggcctcctcaggtacctgcttccctcggaagaggatcagcagcaagtcattgaaggttggcatgattccagctcccaagagagtgtgtctcatccaggagccaaaagaggcgagaacccaccagtacagcagagctgaagcctgttcccagaacgggtctcttgtcccattgcagtcccctgcccgattcagcaaccactgactgttttccaagccccagtccatgaaccagttcgaattgcctatgacaggcctcggggtcgtcccatgtccaaaaagaagaaacccaaggacttggacttcgcccagcagaagctgaccgataagaacctgggcttccagatgctgcagaagatgggctggaaggagggccatggcctgggctccctcggaaagggcatcagggagccggtcagcgtgtacgcagcaggcagcctggggtgggagtgggtggggcctcagtccttccacctgcagcctgccgcttggctccttcacagccaagatggcttacagctggcagttgatttttgttttttaaacagaaggcatcttcagatgagaagctgatcatttacatgtgcaggtgtttacagggctcctttctgtcctggtgtagattttttaaccagcttgttggccctggtcattttggccacatttgtgaccatcataaaagctaagtggtatttctgtgtagtttccgtctggaactgctttcccattcccgggaacccatagccgggccagccagggtcccgaacacaggcccaaagtttattaaaccccgatcataacctccagcaggcatttcatttaatactgagcttagttcctgctgggtaaggcattccgaggtaaccagggccctctgggcaccccctcaaaagccagctcttcgagggtgagtactccttgtttctactgtgagtcgcgtcttgattttccctttctttgatgtctcagtgtgtgtcccaaacacctgcatctcatggactgtttgtgcccatgcccagttcctggcatgccaggccctgggctcaggtgcacaactgactctctttttcactccctaggggaaccccctcggaaggggaagggttgggtgctgacgggcaggagcacaaagaagacacattcgatgtgttccgacagaggatgatgcagatgtacagacacaagcgggccaacaaatagatcaaaaccactgatgtgaaagataagccttgaagcagcaattgcccttaaaacatcatccctgccctggatcggcctggagccagtgcccaagtacggtttggtgtgtacatgaaaacaaacgtctctgcagtctctggggcggaggtttcgctggcttttctttctctcaaagaaaaaaacatgcaccattttcaatgtgcttttgcctctcctctctgttcacatgcttttagcagcaagtcccctccaaatctgtcttggttccccttcagaaggtggcgctgcccccgaaaggcacctcagcctgtgagtgctgaggaaccagctcctctggctgattttccagttggactggccattgctctccagaagtgctctgttagcaaacgtgatgtggaaacgatcacagatggtgttttctcgttgttcgccagaatttatacgggggagacaaattcccggtaattaccaagtctgcactcgggtaccaaagctctgaagctctctgaacagttgccatacttgagttgatgaatgtgttattcatggtgtctcatctcatcaatgcatcttgagagacttaatgaaattttagcaacagtatagaatagctctatcgggtggggagtaatcattaaacagatgaaatcggccccagatttacatgtctctttagaatccacagtgtaagcaaactacagttacaaagggatgggggttgtaaaccctctgagactctgcacttttcgcacgtatggcatcgtcaagtgctgtcttattacagcctttgtaaggagaggcaggctcctcctggggtgggctctgcagctgctctatttccaggcatgtgatcgcccccgctctccagattccccagcactctgctgcgtgtaactccactcaattctccactcatccttccttgtgaagcaggatcgttgaagttttaagtatgggcaaaaatctggaaaacttaggatccctctgacaccccaggattaggggacacagcagtggctagggcatcagccacagaactgagcgggaaatgccacttgtattggctgtaaagaaatcctggctttgggccaggcacagtggctcaagcctgtaatcccagcactttaggaggttgaggcggatggatcacctgaggtcaggagtttgagaccagcctggccaacatggtgtaaccccgtctctactaaaaatacaaaaaaattagccaggcgtggtagcgggcacctgtaatcccagctactcaggaggctgaggcaggagaatcacttgaaccggggaggcagaggttgcagtgagctgagatcatgccactccactccagcctgggcgacagagcaagactccatctcc

SEQ ID NO: 187692 - DNA, 1110 bp, Homo sapiens
  Payload ID: 16945
  Gene Symbol: SMNDC1
  Gene Name: survival motor neuron domain containing 1
  Uniprot ID: O75940
  ENST ID: ENST00000369592
  CDS Start-End: 306-1022
tcccgaggtgaagcggaggcccaaggctgaggagcccgcctcgccggagacgcccaggcgctggccctggatcccggagccacggccgtctctcagccagagctgagcctcggcggcccggccggcgctggcctccgtgcggcggcggcaaacacggcccgcaggggaccgggtcgggtggggctgggcgccgcgcggctccctgtggagcctgcctgttggagcgcggcggggctccggcggtggtcttggagctggcgtgtggatttccacgtccgaatgatcgagttgtggcgggctttgagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttaga

SEQ ID NO: 187693 - DNA, 4341 bp, Homo sapiens
  Payload ID: 16945
  Gene Symbol: SMNDC1
  Gene Name: survival motor neuron domain containing 1
  Uniprot ID: O75940
  ENST ID: ENST00000369603
  CDS Start-End: 205-921
tctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagccccacacaagatgtcagaggatttagcaaagcagctggcaagctacaaagctcagctccagcaagttgaagctgcattatctggaaatggagaaaatgaagatttgctaaaattgaagaaagatttacaagaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaaaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgtttttgttttttgtatgtttgcttttttcctgttttttgttttttccatttacggcagtggtaccatgttttggatgtgtgatgtttatatgggagaacaaaaagctgatgtatagccctgtatacagtgtagatactatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcatttgttggtgtaagtgaacatcatcacagttatcctgagttgagtttaagccaaatacatgcatagaaaagggtcttcctattaatggaagaaggtaatttttaggatgtgtattatttcagttttgtatgtttaacttttattaaataaagtgtttttaaaatctccagggtgtgttaacaaaagggtaaagtctttagctgtcagcacttaaagcaattaaacctccaagtacttgcacacggcattcatgcaagagaatactgagtgtgtgagaggtttcagtaaatgcttaagtattccttccattagaagaaattggatcttaaagggcaaaccaggcctgtgtttataggatgtcctcattttaatgggtgtttgtagatttttggtggaaggggaaaataagtttttatttcatgaattttaattttttttataaattgaaacttaggacagtggtaggtagaattcttcatctctcccttccacacccacccctctcaacccaggagggtcactttttcttcatataattcgtggccacagggtaggacacaaaggacagaaaggcacaaactgcagtagaaaaagggtttgttgaagcctgtaaacttctaaataaaatatactttgttattgtaacatcttaagagcttatcaataatcaagagtagccttgatggattgcaagagaatcctttgaattaaaaagcactgggaagaaatttggtgtcattgtgtgaccccagaaaatggttgttgagattaccttggtggtattagaatagtaattcacttgatgtttgtgtaggcaggactgttaacagtcttgtccctcttttgaccctggggggccttagttttcccagaggactttgcagtaggagagagaaaaagaataaaagtgaccttaaaaaaaaatgttttgaaaatagacctttagaatgaaatcagcaacctttgtgtcaaagatctagatgtggccctttggaaaatcctagtgtcaggatgatgtttgtgtctctgaactaagaggcaggactcctggggagactacctgtcacagtgtgatactgaatttgagaagatgctcaatgagaagcatgatacccacagtattttacagttgaaggtggttaagctctctatattctgaaacaaaatataaaccttgaccttaaaaagctttgttagaaaatttaatgtagagttttccccattaagaaaggagacttgaagctttgaaactgtgacagactgaaatgttaaatattgagttatgggcccctaagtagaaatggttgcatgtaacttaccaaagcttgacgtttgactgttgttaccatttcaaggaaagaacagtcctaacctcccgaaaataaaatgttgagttttagtggtaatcacaggtaacaagtgctattttaattaacatgtagggaggccacagagcatactggaaaacagcaaggactctagagccagactagtgtttgtttattaccatttattacctgtgtattcccatttattacctgtgtattcctctgattcatttttctcagctgtagaatggaaaaatctgtttcagttttaaggattgaattcaaatgtgtaaatagcttaagagtatccggcataagcactatagaagcgtctgctattactctgcagagtggcagtggtgaattatctgatattttttccttaacttgaatagcaatccacattacaatggataacaatacccattgtttatgatttgaggcatccaattataactgtattattgaagtgttatcaaattaccaaggctgtagggtatatttagtattcctagttaaaggtttgaactaatttgtatactagggcatgtttcttaatgggaagggggtgaaggttataataaaagtcacccctaatgcttgtttaaaattaaagaggaatttgtgggcctgggaccaaccttagacttatccaggccaaggtatgttgtttgacgaacaccgcaggtgatcctgatgtgcatccccgtctgagaactgttaactataaaagtttgactttggaaatgaagaaaaattaccttttagcctaatcatgaagactaggcgtcaaaccaaaacaagatgcatcagttactgtagcaacacattttttttaaaaaattgcttgttgtcacaatgaagggtgtgtgtctgtttccagtatgcaattctaatgccaaatgtctgccttaaaaatagcaaaggagaccatcaggttaacataaaggaaaactgtagttgtgtgactcatgtgtctgtagattgtaattttataattacaatttttataagataaaaaactaccagttgtaaattcaaccaaaaaaaatttaaagctttgatttagctttttgctttaacttgggtagtaactgaaatataaaggaagaaaatctattaaaaccaatgaggttttatatttttttaaa

SEQ ID NO: 187694 - DNA, 900 bp, Homo sapiens
  Payload ID: 16946
  Gene Symbol: SMN1
  Gene Name: survival of motor neuron 1, telomeric
  Uniprot ID: Q16637
  ENST ID: ENST00000351205
  CDS Start-End: 1-885
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgcca

SEQ ID NO: 187695 - DNA, 1536 bp, Homo sapiens
  Payload ID: 16946
  Gene Symbol: SMN1
  Gene Name: survival of motor neuron 1, telomeric
  Uniprot ID: Q16637
  ENST ID: ENST00000380707
  CDS Start-End: 75-959
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 187696 - DNA, 1550 bp, Homo sapiens
  Payload ID: 16946
  Gene Symbol: SMN1
  Gene Name: survival of motor neuron 1, telomeric
  ENST ID: ENST00000506239
  CDS Start-End: 30-914
gccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtgatccacccgcctcggccttccaagagaaatgaaatttttttaatgcacaaagatctggggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattag

SEQ ID NO: 187697 - DNA, 1308 bp, Homo sapiens
  Payload ID: 16946
  Gene Symbol: SMN1
  Gene Name: survival of motor neuron 1, telomeric
  ENST ID: ENST00000514951
  CDS Start-End: 49-732
actcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaa

SEQ ID NO: 187698 - DNA, 1445 bp, Homo sapiens
  Payload ID: 16946
  Gene Symbol: SMN1
  Gene Name: survival of motor neuron 1, telomeric
  Uniprot ID: Q16637
  ENST ID: ENST00000506163
  CDS Start-End: 10-858
gggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattagctgtatctgtgattgtatttcttt

SEQ ID NO: 187699 - DNA, 1219 bp, Homo sapiens
  Payload ID: 16946
  Gene Symbol: SMN1
  Gene Name: survival of motor neuron 1, telomeric
  Uniprot ID: Q16637
  ENST ID: ENST00000503079
  CDS Start-End: 75-863
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatat

SEQ ID NO: 187700 - DNA, 431 bp, Homo sapiens
  Payload ID: 16946
  Gene Symbol: SMN1
  Gene Name: survival of motor neuron 1, telomeric
  ENST ID: ENST00000507905
  CDS Start-End: 1-240
ctttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagaaaggaaatgagaaaaatccagaggttgtcatttgacttatgagtctgtttgacttcaggatttggtacatgaaatttcacttaatctttttgatatgtataaaacaaatattctggccaggtctaaaattcaatggcccaccaccgccaccgccaccaccaccaccccacttactatcatgctggctgcctccatttccttctggaccaccaataattcccccacc

SEQ ID NO: 187701 - DNA, 885 bp, Homo sapiens
  Payload ID: 16946
  Gene Symbol: SMN1
  Gene Name: survival of motor neuron 1, telomeric
  ENST ID: ENST00000610814
  CDS Start-End: 1-885
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtga

SEQ ID NO: 187702 - DNA, 804 bp, Homo sapiens
  Payload ID: 16946
  Gene Symbol: SMN1
  Gene Name: survival of motor neuron 1, telomeric
  Uniprot ID: Q16637
  ENST ID: ENST00000622158
  CDS Start-End: 1-789
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgcca

SEQ ID NO: 187703 - DNA, 900 bp, Homo sapiens
  Payload ID: 16946
  Gene Symbol: SMN1
  Gene Name: survival of motor neuron 1, telomeric
  Uniprot ID: Q16637
  ENST ID: ENST00000622739
  CDS Start-End: 1-885
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgcca

SEQ ID NO: 187704 - DNA, 789 bp, Homo sapiens
  Payload ID: 16946
  Gene Symbol: SMN1
  Gene Name: survival of motor neuron 1, telomeric
  ENST ID: ENST00000626580
  CDS Start-End: 1-448
gaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtag

SEQ ID NO: 187705 - DNA, 885 bp, Homo sapiens
  Payload ID: 16946
  Gene Symbol: SMN1
  Gene Name: survival of motor neuron 1, telomeric
  ENST ID: ENST00000625245
  CDS Start-End: 1-885
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtga

SEQ ID NO: 187706 - DNA, 1440 bp, Homo sapiens
  Payload ID: 16946
  Gene Symbol: SMN1
  Gene Name: survival of motor neuron 1, telomeric
  Uniprot ID: Q16637
  ENST ID: ENST00000628353
  CDS Start-End: 33-881
ggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 187707 - DNA, 567 bp, Homo sapiens
  Payload ID: 16946
  Gene Symbol: SMN1
  Gene Name: survival of motor neuron 1, telomeric
  ENST ID: ENST00000630432
  CDS Start-End: 1-430
gaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaag

SEQ ID NO: 187708 - DNA, 678 bp, Homo sapiens
  Payload ID: 16946
  Gene Symbol: SMN1
  Gene Name: survival of motor neuron 1, telomeric
  ENST ID: ENST00000628043
  CDS Start-End: 1-541
gaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaag

SEQ ID NO: 187709 - DNA, 423 bp, Homo sapiens
  Payload ID: 16946
  Gene Symbol: SMN1
  Gene Name: survival of motor neuron 1, telomeric
  ENST ID: ENST00000627306
  CDS Start-End: 1-240
ctttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagaaaggaaatgagaaaaatccagaggttgtcatttgacttatgagtctgtttgacttcaggatttggtacatgaaatttcacttaatctttttgatatgtataaaacaaatattctggccaggtctaaaattcaatggcccaccaccgccaccgccaccaccaccaccccacttactatcatgctggctgcctccatttccttctggaccaccagtaagt

SEQ ID NO: 187710 - DNA, 1512 bp, Homo sapiens
  Payload ID: 16946
  Gene Symbol: SMN1
  Gene Name: survival of motor neuron 1, telomeric
  Uniprot ID: Q16637
  ENST ID: ENST00000629122
  CDS Start-End: 48-932
ctcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 187711 - DNA, 867 bp, Homo sapiens
  Payload ID: 16946
  Gene Symbol: SMN1
  Gene Name: survival of motor neuron 1, telomeric
  ENST ID: ENST00000631131
  CDS Start-End: 49-732
actcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaata

SEQ ID NO: 187712 - DNA, 900 bp, Homo sapiens
  Payload ID: 16947
  Gene Symbol: SMN2
  Gene Name: survival of motor neuron 2, centromeric
  Uniprot ID: Q16637
  ENST ID: ENST00000380741
  CDS Start-End: 1-885
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgcca

SEQ ID NO: 187713 - DNA, 1388 bp, Homo sapiens
  Payload ID: 16947
  Gene Symbol: SMN2
  Gene Name: survival of motor neuron 2, centromeric
  Uniprot ID: Q16637
  ENST ID: ENST00000380742
  CDS Start-End: 23-811
gctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 187714 - DNA, 1536 bp, Homo sapiens
  Payload ID: 16947
  Gene Symbol: SMN2
  Gene Name: survival of motor neuron 2, centromeric
  Uniprot ID: Q16637
  ENST ID: ENST00000380743
  CDS Start-End: 75-959
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 187715 - DNA, 867 bp, Homo sapiens
  Payload ID: 16947
  Gene Symbol: SMN2
  Gene Name: survival of motor neuron 2, centromeric
  ENST ID: ENST00000511812
  CDS Start-End: 49-732
actcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaata

SEQ ID NO: 187716 - DNA, 1550 bp, Homo sapiens
  Payload ID: 16947
  Gene Symbol: SMN2
  Gene Name: survival of motor neuron 2, centromeric
  ENST ID: ENST00000506734
  CDS Start-End: 30-914
gccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtgatccacccgcctcggccttccaagagaaatgaaatttttttaatgcacaaagatctggggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattag

SEQ ID NO: 187717 - DNA, 1045 bp, Homo sapiens
  Payload ID: 16947
  Gene Symbol: SMN2
  Gene Name: survival of motor neuron 2, centromeric
  ENST ID: ENST00000507458
  CDS Start-End: 1-139
atgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatggagtctcgctctgctgcccacgctggagtgcagtggtgcaatctcagctcactgcaacctctgctatccgggttcaagcagttctcgtgcctcacccacgtgagtagttgggattacaggcatgtggcaccatgccccactaagttttgtatttttagtagagatggagtttcaccatgttggccaggctggtctcaaactcctgccctcaagtgattcgaccaccctggcctcccaaagtgctgggattacagccgtgagccaccgcacacggcctctctatttatttctatacatagcttttcacattatattatgtttatatattgtttatatctgtatttcctctttcattagagaaaaggtagtacatcttattcttcatggtgtctacaatatctggcagtttttggaagtcaagcgtgagcttagagcatagactggtgggattgtcaaagaagagggcaactggaagagaactgtcagttatttttggatcagtctttaattcatcatgacgggttaggcattagttgtatttcttgctaattttgaagaagacttattaacaaatcctacattaggtaaatggttttgaaagttgagttaatcataatggtgtttgacctaggactatttttaggccctatttatcttaatatcgaataatgaagcagcttcccccttagatatagacagaaaacatcaaagccaccacactacctggctggatttatcctagtaataaaatcaaaactgagc

SEQ ID NO: 187718 - DNA, 431 bp, Homo sapiens; identical to SEQ ID NO: 187700
  Payload ID: 16947
  Gene Symbol: SMN2
  Gene Name: survival of motor neuron 2, centromeric
  ENST ID: ENST00000511873
  CDS Start-End: 1-240

SEQ ID NO: 187719 - DNA, 885 bp, Homo sapiens; identical to SEQ ID NO: 187701
  Payload ID: 16947
  Gene Symbol: SMN2
  Gene Name: survival of motor neuron 2, centromeric
  ENST ID: ENST00000612974
  CDS Start-End: 1-885

SEQ ID NO: 187720 - DNA, 1550 bp, Homo sapiens
  Payload ID: 16947
  Gene Symbol: SMN2
  Gene Name: survival of motor neuron 2, centromeric
  ENST ID: ENST00000612446
  CDS Start-End: 30-914
gccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtgatccacccgcctcggccttccaagagaaatgaaatttttttaatgcacaaagatctggggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattag

SEQ ID NO: 187721 - DNA, 867 bp, Homo sapiens; identical to SEQ ID NO: 187711
  Payload ID: 16947
  Gene Symbol: SMN2
  Gene Name: survival of motor neuron 2, centromeric
  ENST ID: ENST00000619658
  CDS Start-End: 49-732

SEQ ID NO: 187722 - DNA, 804 bp, Homo sapiens
  Payload ID: 16947
  Gene Symbol: SMN2
  Gene Name: survival of motor neuron 2, centromeric
  Uniprot ID: Q16637
  ENST ID: ENST00000614240
  CDS Start-End: 1-789
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgcca

SEQ ID NO: 187723 - DNA, 885 bp, Homo sapiens
  Payload ID: 16947
  Gene Symbol: SMN2
  Gene Name: survival of motor neuron 2, centromeric
  Uniprot ID: Q16637
  ENST ID: ENST00000614610
  CDS Start-End: 1-885
atggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaa

SEQ ID NO: 187724 - DNA, 1045 bp, Homo sapiens
  Payload ID: 16947
  Gene Symbol: SMN2
  Gene Name: survival of motor neuron 2, centromeric
  ENST ID: ENST00000620650
  CDS Start-End: 1-139
atgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatggagtctcgctctgctgcccacgctggagtgcagtggtgcaatctcagctcactgcaacctctgctatccgggttcaagcggttctcgtgcctcacccacgtgagtagttgggattacaggcatgtggcaccatgccccactaagttttgtatttttagtagagatggagtttcaccatgttggccaggctggtctcaaactcctgccctcaagtgattcgaccaccctggcctcccaaagtgctgggattacagccgtgagccaccgcacacggcctctctatttatttctatacatagcttttcacattatattatgtttatatattgtttatatctgtatttcctctttcattagagaaaaggtagtacatcttattcttcatggtgtctacaatatctggcagtttttggaagtcaagcgtgagcttagagcatagactggtgggattgtcaaagaagagggcaactggaagagaactgtcagttatttttggatcagtctttaattcatcatgacgggttaggcattagttgtatttcttgctaattttgaagaagacttattaacaaatcctacattaggtaaatggttttgaaagttgagttaatcataatggtgtttgacctaggactatttttaggccctatttatcttaatatcgaataatgaagcagcttcccccttagatatagacagaaaacatcaaagccaccacactacctggctggatttatcctagtaataaaatcaaaactgagc

SEQ ID NO: 187725 - DNA, 1221 bp, Homo sapiens
  Payload ID: 16947
  Gene Symbol: SMN2
  Gene Name: survival of motor neuron 2, centromeric
  Uniprot ID: Q16637
  ENST ID: ENST00000614773
  CDS Start-End: 75-863
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttagaaagttgaaaggttaatgtaaaacaatcaatattaaagaattttgatgccaaaactattagataaaaggttaatctacatccctactagaattctcatacttaactggttggttgtgtggaagaaacatactttcacaataaagagctttaggatatgatgccattttatatcactagtaggcagaccagcagacttttttttattgtgatatgggataacctaggcatactgcactgtacactctgacatatga

SEQ ID NO: 187726 - DNA, 417 bp, Homo sapiens
  Payload ID: 16947
  Gene Symbol: SMN2
  Gene Name: survival of motor neuron 2, centromeric
  ENST ID: ENST00000617648
  CDS Start-End: 1-240
ctttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagaaaggaaatgagaaaaatccagaggttgtcatttgacttatgagtctgtttgacttcaggatttggtacatgaaatttcacttaatctttttgatatgtataaaacaaatattctggccaggtctaaaattcaatggcccaccaccgccaccgccaccaccaccaccccacttactatcatgctggctgcctccatttccttctggaccacca

SEQ ID NO: 187727 - DNA, 1492 bp, Homo sapiens
  Payload ID: 16947
  Gene Symbol: SMN2
  Gene Name: survival of motor neuron 2, centromeric
  Uniprot ID: Q16637
  ENST ID: ENST00000618251
  CDS Start-End: 31-915
ggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 187728 - DNA, 804 bp, Homo sapiens; identical to SEQ ID NO: 187702
  Payload ID: 16947
  Gene Symbol: SMN2
  Gene Name: survival of motor neuron 2, centromeric
  Uniprot ID: Q16637
  ENST ID: ENST00000611442
  CDS Start-End: 1-789

SEQ ID NO: 187729 - DNA, 900 bp, Homo sapiens; identical to SEQ ID NO: 187703
  Payload ID: 16947
  Gene Symbol: SMN2
  Gene Name: survival of motor neuron 2, centromeric
  Uniprot ID: Q16637
  ENST ID: ENST00000618661
  CDS Start-End: 1-885

SEQ ID NO: 187730 - DNA, 1388 bp, Homo sapiens
  Payload ID: 16947
  Gene Symbol: SMN2
  Gene Name: survival of motor neuron 2, centromeric
  Uniprot ID: Q16637
  ENST ID: ENST00000624634
  CDS Start-End: 23-811
gctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagataattcccccaccacctcccatatgtccagattctcttgatgatgctgatgctttgggaagtatgttaatttcatggtacatgagtggctatcatactggctattatatgggtttcagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 187731 - DNA, 431 bp, Homo sapiens
  Payload ID: 16947
  Gene Symbol: SMN2
  Gene Name: survival of motor neuron 2, centromeric
  ENST ID: ENST00000625462
  CDS Start-End: 1-240
ctttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagaaaggaaatgagaaaaatccagaggttgtcatttgacttatgagtctgtttgacttcaggatttggtacatgaaatttcacttaatctttttgatatgtataaaacaaatattctggccaggtctaaaattcaatggcccaccaccgccaccgccaccaccaccaccccacttactatcatgctggctgcctccatttccttctggaccaccaataattcccccacc

SEQ ID NO: 187732 - DNA, 885 bp, Homo sapiens; identical to SEQ ID NO: 187701
  Payload ID: 16947
  Gene Symbol: SMN2
  Gene Name: survival of motor neuron 2, centromeric
  ENST ID: ENST00000629741
  CDS Start-End: 1-885

SEQ ID NO: 187733 - DNA, 1550 bp, Homo sapiens
  Payload ID: 16947
  Gene Symbol: SMN2
  Gene Name: survival of motor neuron 2, centromeric
  ENST ID: ENST00000631104
  CDS Start-End: 30-914
gccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgacagggtttcactgtgttagccaggatggtctcaatctcctgaccccgtgatccacccgcctcggccttccaagagaaatgaaatttttttaatgcacaaagatctggggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattag

SEQ ID NO: 187734 - DNA, 1440 bp, Homo sapiens
  Payload ID: 16947
  Gene Symbol: SMN2
  Gene Name: survival of motor neuron 2, centromeric
  Uniprot ID: Q16637
  ENST ID: ENST00000626847
  CDS Start-End: 33-881
ggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacaaaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaa

SEQ ID NO: 187735 - DNA, 885 bp, Homo sapiens; identical to SEQ ID NO: 187705
  Payload ID: 16947
  Gene Symbol: SMN2
  Gene Name: survival of motor neuron 2, centromeric
  ENST ID: ENST00000628696
  CDS Start-End: 1-885

SEQ ID NO: 187736 - DNA, 867 bp, Homo sapiens; identical to SEQ ID NO: 187715
  Payload ID: 16947
  Gene Symbol: SMN2
  Gene Name: survival of motor neuron 2, centromeric
  ENST ID: ENST00000625687
  CDS Start-End: 49-732

SEQ ID NO: 187737 - DNA, 1416 bp, Homo sapiens
  Payload ID: 16947
  Gene Symbol: SMN2
  Gene Name: survival of motor neuron 2, centromeric
  Uniprot ID: Q16637
  ENST ID: ENST00000628642
  CDS Start-End: 10-858
gggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaa

SEQ ID NO: 187738 - DNA, 1539 bp, Homo sapiens
  Payload ID: 16947
  Gene Symbol: SMN2
  Gene Name: survival of motor neuron 2, centromeric
  Uniprot ID: Q16637
  ENST ID: ENST00000627341
  CDS Start-End: 75-959
agaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacatttgtgaaacttcgggtaaaccaaaaaccacacctaaaagaaaacctgctaagaagaataaaagccaaaagaagaatactgcagcttccttacaacagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaagccaggtctaaaattcaatggcccaccaccgccaccgccaccaccaccaccccacttactatcatgctggctgcctccatttccttctggaccaccaataattcccccaccacctcccatatgtccagattctcttgatgatgctgatgctttgggaagtatgttaatttcatggtacatgagtggctatcatactggctattatatgggttttagacaaaatcaaaaagaaggaaggtgctcacattccttaaattaaggagaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactgaggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaatta

SEQ ID NO: 187739 - DNA, 2861 bp, Homo sapiens
  Payload ID: 16948
  Gene Symbol: SUSD1
  Gene Name: sushi domain containing 1
  ENST ID: ENST00000355396
  CDS Start-End: 1-2119
gttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaatt

SEQ ID NO: 187740 - DNA, 2973 bp, Homo sapiens
  Payload ID: 16948
  Gene Symbol: SUSD1
  Gene Name: sushi domain containing 1
  ENST ID: ENST00000374263
  CDS Start-End: 63-2231
atctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaatt

SEQ ID NO: 187741 - DNA, 2754 bp, Homo sapiens
  Payload ID: 16948
  Gene Symbol: SUSD1
  Gene Name: sushi domain containing 1
  Uniprot ID: Q6UWL2
  ENST ID: ENST00000374264
  CDS Start-End: 33-2306
gcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagaaataccttgtaactgtaatttcctgaggctgcatatccacagggccaactcaggggacacacagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattca

SEQ ID NO: 187742 - DNA, 3124 bp, Homo sapiens
  Payload ID: 16948
  Gene Symbol: SUSD1
  Gene Name: sushi domain containing 1
  Uniprot ID: Q6UWL2
  ENST ID: ENST00000374270
  CDS Start-End: 174-2417
gaggaaggacccgcgctctgcggcctcccggggaccccgcagcgccccccgcttccctcggcggcgccggaagccgccggctggtcccctccccgcggcgcctgtagccttatctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaatt

SEQ ID NO: 187743 - DNA, 842 bp, Homo sapiens
  Payload ID: 16948
  Gene Symbol: SUSD1
  Gene Name: sushi domain containing 1
  ENST ID: ENST00000415074
  CDS Start-End: 1-842
atggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctggtagcagaaactcccacgggagaaatacacatataaaagaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtg

SEQ ID NO: 187744 - DNA, 743 bp, Homo sapiens
  Payload ID: 16948
  Gene Symbol: SUSD1
  Gene Name: sushi domain containing 1
  ENST ID: ENST00000475283
  CDS Start-End: 1-138
gtgattactgcattatattacgaatcacaagtgaatggaataagcatcaagttcatattgatgagatctgtttatataattgtcactggtgaccagaacccaattcatactactttaagcaaagagcttcatagctgaaaaaaaatgggaggagggtgagtggatgggagcttatggaattatacaaagagctaccccaccaagaaggctccaggaactgggactggggactcaacaccattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaa

SEQ ID NO: 187745 - DNA, 3404 bp, Homo sapiens
  Payload ID: 16949
  Gene Symbol: SUSD2
  Gene Name: sushi domain containing 2
  Uniprot ID: Q9UGT4
  ENST ID: ENST00000358321
  CDS Start-End: 262-2730
ctcctcaccctcccacagggtcccagggccgatccaggcctgcgggccaggaatgtgctaacggggcaacttgggccttgctggtccacgcaggcacctgtggactttgagaggggactgggtggggaggggcggggaggggcggggcggggcggtgccgcagagtgcagggcgggcggggccaggccagcagggagtgagcttgtctggccgcctcgcctcggagccactgcactgctggctgcagacacaggctgcaccatgaagccagccctcctgccctgggccctgctgctgctggcgacagccctcggcccgggccccggacccacagcagatgcccaagagagctgctccatgcgctgtggcgccctggacgggccatgttcctgccacccgacgtgctctggccttggcacctgctgcttggatttccgggacttctgcctggagatattgccctactcaggatccatgatgggcggcaaggactttgtggtgcggcacttcaagatgtccagccccacagacgccagtgtgatctgcaggtttaaggacagcatccagaccctcggccatgtggactcctccgggcaagtgcactgtgtgtcacctctgctctatgagagcggccgcatccccttcactgtgtcactggacaacggccactccttccctcgtgcgggcacctggctggctgtgcaccccaacaaagtgtcaatgatggagaagagcgagttggtgaacgagacgcgttggcaatactacggcaccgccaacacctcaggcaacctcagcctgacctggcatgtcaagtcgctgcccacgcagaccatcaccatcgaactgtggggctacgaggagacaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaaggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcacggactacggctgtgacatggagcagggcagcgtgtgcacctaccaccccggggccgtgcactgtgtgcgttctgtgcaggccagcctccggtacggctcaggtcagcagtgctgctacacagcggacgggacgcagctcctgacagctgactccagcggcggcagcactcccgaccgcggccatgactggggcgcacccccgttccgcacgccaccccgagtgcccagcatgtcccactggctctacgatgtcctcagcttctattactgctgcctctgggcacccgactgcccccgctacatgcaacggcggccctccaatgactgccgcaactaccggcccccaagactggcctccgccttcggagacccacactttgtgaccttcgacggcaccaacttcacattcaatgggcgcggagagtacgtgctgctggaggcagcgctgaccgacctgagggtgcaggcgcgggcccagcccgggacgatgtccaacggcacggagacccgtggcactgggctgaccgcagtggccgtccaggagggcaactcagatgtggtggaagtcaggctggccaacaggaccggaggtctggaggtgctgctgaaccaggaggtgctgagcttcaccgagcagagctggatggacctgaaaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggacgcagctacgcggtgctgttgggcatcatctttgggggcctcgcggtggtggcggcggttgcgctcgtctatgtgctgctgcgccgcaggaagggcaacacgcacgtctggggtgcacagccctgatgggagcagcttggctgtgagcaccaggccaagactcctgagaacaggcagcccagtcctgcgactcccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatagctcactccctagagcctgacgccggggcccctgacccctgagcctcagattccaatacctcactccccagagcctgatgccggggcccctgacccctgatctacggaggcctgctcccggaccgtgcgggcaccagtgcagtgctgccttggttcctggacccctgggcccatcctgggaccccagatggggtaaggagaggccccagaaccccaaagcagacagcgagacccccagcggcagaggcctccctcggcactccaggcttataatttcgaactcttctggaaggtcactcaggaacaccctccctgcctgtgcaaagagaaaacaagcgccttgtttccttccctg

SEQ ID NO: 187746 - DNA, 1114 bp, Homo sapiens
  Payload ID: 16950
  Gene Symbol: SUSD3
  Gene Name: sushi domain containing 3
  Uniprot ID: Q96L08
  ENST ID: ENST00000375469
  CDS Start-End: 1-729
atgaaaaacataggccttgtgatggaatgggaaattccagagataatttgcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaactac

SEQ ID NO: 187747 - DNA, 1195 bp, Homo sapiens
  Payload ID: 16950
  Gene Symbol: SUSD3
  Gene Name: sushi domain containing 3
  Uniprot ID: Q96L08
  ENST ID: ENST00000375472
  CDS Start-End: 37-804
ctggcagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaactacagaaaa

SEQ ID NO: 187748 - DNA, 745 bp, Homo sapiens
  Payload ID: 16950
  Gene Symbol: SUSD3
  Gene Name: sushi domain containing 3
  ENST ID: ENST00000471462
  CDS Start-End: 1-359
tggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacagagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaactaca

SEQ ID NO: 187749 - DNA, 463 bp, Homo sapiens
  Payload ID: 16950
  Gene Symbol: SUSD3
  Gene Name: sushi domain containing 3
  ENST ID: ENST00000465709
  CDS Start-End: 1-463
aggccccgggggcgggccggggtcaccacgcctgccccagggaaccgcacagtggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatgg

SEQ ID NO: 187750 - DNA, 1076 bp, Homo sapiens
  Payload ID: 16950
  Gene Symbol: SUSD3
  Gene Name: sushi domain containing 3
  ENST ID: ENST00000617293
  CDS Start-End: 56-691
acaagccgggctcactcccctggcagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacagagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaactac

SEQ ID NO: 187751 - DNA, 1056 bp, Homo sapiens
  Payload ID: 16951
  Gene Symbol: SUSD4
  Gene Name: sushi domain containing 4
  Uniprot ID: Q5VX71
  ENST ID: ENST00000344029
  CDS Start-End: 147-1019
gtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaaggaggaagacctgaacatcttttccctgtcctttatttcccacacatcaggttggcagctgctgtgctttatttttgccctgtgttaaagtcctctcccaccccagcacctacctgttcctcaactagcaccaccacatctctgttctaaatgttgttctcctgcaataaaggacgtttgaattaaa

SEQ ID NO: 187752 - DNA, 3480 bp, Homo sapiens
  Payload ID: 16951
  Gene Symbol: SUSD4
  Gene Name: sushi domain containing 4
  Uniprot ID: Q5VX71
  ENST ID: ENST00000343846
  CDS Start-End: 635-2107
caggtaagaccgacagtcccggaagggtcttccattccgaggaggcgcgcgcaggccggggagggggagttggtgcctggtgcagctccccaagggagaattttttttttttttttgacagcgcagagaaatctcactggggactggggcagtaggatcgatcccaatcccgaggaaaaccagagaagtagctgggggagacggtgccacattgtgagattcccagagtgaaatgtataggcccagggaaaagtgtcttcgcggccccgagacgcggggaggctctagactttcctgtggtgggcacagctgctgaatcccggggaccggcgcggagccaatgtgcgctaacccctgccctccctcctgtcctccatcccccagcacgcgcagcatcccacggcggctgttactcagtgcacccggctcgggggaaggcgggggacctcgccgtgggaaagggggcgggggccgcgcgggggaggaaccaggatggagcctgggaagccgaggcgccgggtcccagagcggaggagggggagcgtggcccccgagcccggacagactggcttattgtggtgttccgcttctggttgcagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaatgacagtttgaa

SEQ ID NO: 187753 - DNA, 3025 bp, Homo sapiens
  Payload ID: 16951
  Gene Symbol: SUSD4
  Gene Name: sushi domain containing 4
  Uniprot ID: Q5VX71
  ENST ID: ENST00000366878
  CDS Start-End: 182-1654
gggagctggagccgagcgccgccgccgaagcttccgtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaatgacagtttg

SEQ ID NO: 187754 - DNA, 1833 bp, Homo sapiens
  Payload ID: 16951
  Gene Symbol: SUSD4
  Gene Name: sushi domain containing 4
  ENST ID: ENST00000494793
  CDS Start-End: 158-1624
ccgaagcttccgtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaa

SEQ ID NO: 187755 - DNA, 2736 bp, Homo sapiens
  Payload ID: 16951
  Gene Symbol: SUSD4
  Gene Name: sushi domain containing 4
  ENST ID: ENST00000484758
  CDS Start-End: 110-1375
cgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagcccaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaa

SEQ ID NO: 187756 - DNA, 2566 bp, Homo sapiens
  Payload ID: 16951
  Gene Symbol: SUSD4
  Gene Name: sushi domain containing 4
  ENST ID: ENST00000608996
  CDS Start-End: 1-1391
tggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagcccaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagt

SEQ ID NO: 187757 - DNA, 5008 bp, Homo sapiens
  Payload ID: 16952
  Gene Symbol: SUSD5
  Gene Name: sushi domain containing 5
  Uniprot ID: O60279
  ENST ID: ENST00000309558
  CDS Start-End: 419-2308
gccaagggtcccccagacgggcgggggctccttgcggccggctagctactctccccgcctccctgcgccctcgccctccgccccgctgtacccgcagagcgcgcggcccagcgcagccccttttggcaccgaggtttccaggtgcccagcgcgaaggcggagccgggttacagccgcctcctcggcgccacagagaagacccccgggagttcggcggcccaggcgctccggctctgcgtcccgagcctcccccggctctccgcgctcctccctctcggcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggaccatgactgccgagggacccagcccgcctgcccgttggcacagacgcctccccgggctctgggcggcggcgctgctcctgctcggtctgccgcgcctttcggtgcgggcggatggaaagttctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagagaagccgtgtggagacccgccttcgttcccacacaccatcctgcagggccgcaccggcttggaaatgggggatgaactgctgtacgtgtgtgccccaggccacatcatgggccaccgggagaccgccttcaccttgctatgtaacagctgtggggagtggtacggcctggtgcaggcctgtgggaaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggcttgcctggtgctgggagcagtgtccccgcagattcaccaggatcacggctgctccagaagcacttgttctggtttcctgctgaggctttccacaagcctgggttggaaaaggaggtggatgatgacaccaaaaagcagttttctgctggagacaaccacagtggtgtaaaattggtcccaggtgaacctgaaaccaaggtgatctacggcaacactgatggtccctcggggccatttgtgggcaagaatgacagcaaggcaggagatccagtggtgagcagcagtgatgagtcctggttagatggctaccctgtgacagagggggcttggaggaagacagaggcagaagaggaagaagatggggacagaggggatgggtcagtagggctggatgaaaacgtcctagttactcctgatcagcccattcttgtggaagttaagaagcccaagagtagcaccctcacaccaagcgagggcatgacccatagttcagttcttccatctcaaatgctagatgtggaagctttggcgctcagacccgtgaatgcttccgagactgagggcattggggatggtgacttgacgaagtaccagtcaactctaccctggagattcatcacagaggaatctcccatggccaccctgtcctatgagctcaccagctccaccctggagatattaacagtgaacactgtcaagcagacacctaaccacatcccctcaacgatcatggcaaccacccagcctccagtagaaaccactgttcctgagatccaggatagcttcccatacctgctgtctgaagacttctttggacaggaaggccccgggccaggtgcaagtgaggagcttcatcccaccttggagtcgtgtgtgggggacggatgtcctggcctcagcagaggccctgtgatcgccaccattgtcaccgtcctgtgcctactgctgctcctggcaggtgtggggatggtgtggggctaccgcaagtgccagcacaagagctctgtgtacaagctgaatgttggccagcggcaggctcggcactaccaccagcagatcgagatggagaaggtctaggcacctttggagtgggttctcccaaagccacttgggaggaaaataactgtgacacatcacacgataattcactagagcatgacgcaggtggactgaggctcatcattttttcctcagccctttgttttataggctgagaagtgtctctggagcacctgggagggcagggaggctttggtgacatcatcactcatgtcaatgtctcctccaccatctgccctggaattgactacactaatcccagacctgtgcttgggccctgtttccagtgtgaggtcaaaaatcgcctcttccttcatcacagtattatctttttttttttgagacagagtctcatgctgttgcccaggctggagtgcagtgtcccgatctgagctcactgcaacctctgcctcccaagttcaagcaattctcctgcctcagcctcccaagtaggtgggattacaggcatgcaccaccatgcccagctaatttttttatatttttagtagagatggagtttcaccatgttggccaggctggtcaagaactcctgacctcaagtgatctgccctccttagcctcccaaagtgctaggattccaggtgtgagccacatcacagtattacctttttgaagaaagaaaatcaccagcttcatgccctgaaattttataaatagtcatgataaaccaagtgtatgagagcagtattatctaggacatggatattgaattattgggagaggaatatggaagaataatgggttgtttccttttaatgttgtgatgttgctgagggcagatgaaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgtcatttattttattttattttcaatatttcatggttaaggatttgccattattttttaaaaacaaagttagctttgtaccagtaagtaccatttcctctcagaagcagtggcctagttgtccttgaccagtctgtgcctaggaatgtcttggaatttttgccaggactaacaaaactcagtccttggtttcctctctcaggattaaccatttctctgaactccagtaagagagaatgacacgggagaaaaaaaaaagaaatgttttcagagggccgaacaccaggttatcaagtatgggcacatacttgatggagaagcagaagaatctgtgaaagaatatgaaatgatctgtgctgatctgttctctagtgtggaaactgggagctctgtggaaacagaatccatcctgtctgttgggtaacccatttcgtagcatctaaatcatcttagggtggctcagcgaggatggtttatggcagtggttctcaaagtgtggtcctcagaccagtagcatcagcgtcacctgggaatttgttggagatgcaaattctctagtcccaccctggactcaggaaacaggaaccctgggagtagggcccagttctgtttttaacaagccctccaggtgattttgatatgcactcaagtttgagagcctgttggtttataataatctcaaatgtgaacttcgaggccagctgaagccctaaaggcacagatgagtatgtggtgtgtgttgtgtggaagtcaggcatggctgtgtgcagctgaggtggcatttgaagctgcctaaatgccacctgcaatagtctcctgtatgttggcacagaaatgaaacatgttatatttttctaatatgaatcaccttcttagaaatagttatcagtggtaaaaagtgatgaatgcaacacatttattttgagacaccatagcagtctaagtgtttttgtgtggtagagggaaatcctgatcttttttatgattgaaaaattgttggtggtgttttacctaaggaaaaaaaacattcgcaacatgttttctaccctgccacctcttttcagcaagctttggaaaagtaataggcgaagtagctgtaaagagaggcagcataatcaaagatcttattccccatagttgggtaaaataaagcctgaaggtaccaactagaatacctgtgcatcagacgaagtcaagaacaataggaataaaatgctttctgcatgtagccaaagcaaaacataatagaataaaagccagagactgtatatatttataaattagatcctaatctactgcaagataacttttctatttttaactatataaaataacctctgtctcagcattgggactgtgttagcaactattattgtggaataacccagaacattggatttataccaacaaataggcaatattaatacagtgtattaataaatttattacaaattattaatacagtgtattaataaatttattacaaattattaatacaggtaaatgttttatttgtagacatggactgtgaaataaacccaacacatcagtttttaagttcttattggtgtggtatcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgccccaac

SEQ ID NO: 187758 - DNA, 729 bp, Homo sapiens
  Payload ID: 16952
  Gene Symbol: SUSD5
  Gene Name: sushi domain containing 5
  ENST ID: ENST00000412539
  CDS Start-End: 1-729
ctgccgagggacccagcccgcctgcccgttggcacagacgcctccccgggctctgggcggcggcgctgctcctgctcggtctgccgcgcctttcggtgcgggcggatggaaagttctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggcttgcctggtgctgggagcagtgtccccgcagattcaccaggatcacggctgctccagaagcacttgttctggtttcctgctgaggctttccacaagcctgggttggaaa

SEQ ID NO: 187759 - DNA, 5388 bp, Homo sapiens
  Payload ID: 16953
  Gene Symbol: SUSD6
  Gene Name: sushi domain containing 6
  Uniprot ID: Q92537
  ENST ID: ENST00000342745
  CDS Start-End: 314-1225
agtgacgcgggcgctgcagccgtcgctaccgccgcgttctattctccgaagccggcgaccgccccacctcctccctccctcccgcccgcttcctctgcccacagcgccggccagagcgagctagacaagggcacgcggggcctcgcctagacccgagaagactgcgggcgcgcgcaagcggcggcgtggaagctgtgagcgcccccatcccggaggtctccgccggctcccgggtgaatcagctcccggccgactttaggattcttctggattttaaattttttctttttaaaaaaacttggacggataaaagatgtgccatggcaggatagcaccaaagagcacctcagtgtttgccgtggcctccgtgggacatggagtgttccttccgctagtgatcctttgcaccctgcttggagacggacttgcttccgtgtgccccctaccaccggagccagagaatggtggctacatctgccacccccggccctgcagagaccccctgacagcaggcagtgtcatcgaatacctgtgtgctgaaggctacatgttgaagggcgattacaaatacctgacgtgtaagaatggcgagtggaaaccagccatggagattagctgccgtctcaacgaggataaagacacccacacatcacttggggtccccacgctgtctatagtggcttctactgccagctccgtggcgctcattctcctcctcgtggtgctgtttgtgctgctgcagccaaagctgaagtctttccatcatagcaggcgtgaccagggggtatctggggaccaggtctccatcatggtggatggagtccaggttgcactaccatcatacgaggaggctgtatatggcagttctggtcactgtgtgccacctgctgaccccagagtacagattgtgctgtcagaagggtctgggcccagtgggaggagcgtgccaagggagcaacagctgccggaccaaggggcctgctcctctgcaggtggagaagatgaggccccaggccagtctggactatgtgaagcctggggctctcgggcctcagagactgtgatggtgcatcaggcaaccacctcttcctgggtggccggctcagggaaccgccaactggcacacaaagaaactgcagattcagagaacagtgacatacaaagccttttatccctcacgtcagaggagtacacagatgatattccactgttgaaagaagcatgagggcagcggccagcctttcctctctgcgaggttctctcagcccttcctccctctccctgtgggattgagcaccctgtactctccagccaccttacctggatacctgagctgccacctgtgtatctgtgtatctctgagggccctataggcccaccttgctggaaactcaaggaagattctcgccatctgcctgttggacagctggaggagctggctctttgcctggccccgccttcccatctgtcagagacatatttgaatgtgctggatcaaaccctcccttttcctaagcctctgggtcccctccagccagctctttggcggcagcccccaccagctcctgtgggcctgagtgctgctgtgtttacttgtgcctttcccccaccctgtccagtttccctgtcatgcagacttgttgctgtccacaagccttagtggctgcactgctgccccctgccacacagggggccgggcctgggtctgtcctgtttcctttgagggttgcccctactgccctttgcaggaacagatccaggtgtgagagctcttgagtcaagagtggcagaagtggctctaattggggtgagagtgtagtccctgggcttgccctgggttgaccctggtggcatatttccttggctgaggatggaagatttggagaatcatgtccatgctggcccaggacccagccatctggcccaaaggcacaagctcctggccctgttgagttgagagtttccaagaagcatccagaagatcccaagggagagaaggaaaatggctgataatgattgtcttcctaatatgcaagttctcacttcctacttccagcatcggccttcctggccttgtcttttttttgtttccctggagtataatgggaagttgcatgctgcctcctgggttttatcccagatagctctggctttcttgctgcccacaggggcctggggcaggaaggagacttgctgagatgccatggagtgcccatctggtcactggcagtctgggcaggttgcccctttctgggtttgtggtgacggaggggaggccgagaggcacagaccaagtccccgggtggctgcaggcagctccagcccggtcctgaggatcctcctcaccatggtcacgtgccttagtaactgtgcccaggaagtggcctgctgcttgctgtgctgctgcttttcctacttctgcccttccctgccacccctcgcatgtcacagctgacaagcaattccttgtcttccctggccccctgggggaagggctgagaaacagtccgtgtgcaccccaaccttaatggcctgaggtgggcagaggggtgtggagcagcctggagtacagggccctgggggaggagcccactgatgaggggcgctctcccatagccatgtgttgaatgctaactaggctggggtggacgaactctgccaactgctgtcatcttagaagatagatgcagcagtaaggaatgtttgttttgcttttttctgaaattttctgaagcactgtggctgggaaacttcgaagcggaccctgtgctgcatgtctgctcctcccctgagcctgtctgcttgggggtggtaaaaataaaaatcccagtttattttcagtaccttacctaacagggttggctccaggcgtgggtggcctagaagatgaggggagtggtcttctcccagccttttaccctcttgcctcctgcctccgcgcttacacacgcactttaccacccggtcattccctggcctcttgctgccacttgtagtcttccttccttcctctcagggtaagggcagtgcctgctgtgcctgttggccactcccacacttcccctcccccaggagccctcatctgctgtgctgagtccaggaaagcatagttaggtagggagctggttggagaaggtgctagaactagaaggcagatgagactagcatgggcccacctggagggctgtccctaatggccccagtcgccttacctcacccacagcagtgcccttgtcttcctccaaaacagaaagcagtgacaaaagggggaggggtggtaatctgaagtctcactgctgagccttcagcttttatttttcactgtttcaaaacccgcattctattctagaatggtttttaaaatggaagatcttacctttttctatcttgttactctggggttttgtccccctaagagattgcactttttgtttggggtttattcagctgcatagatgaccagcttgatccctggtgaaatgaaaagccttccttctcctgaagcctctttccgccctgccctccactaacaacactgaggagcacaagcccaggcttgcccacctggtaggaaaggaagaaattagaacaatgggagccttggctcccctctcgtctcctcccctccttcttgtcactggctttgatgaggcccacttcccagaggctcctgggcctgtgagtgcaggagctcattctcccctcactgctgaagtctgtgacagcttcttcctccagttatgtctttcttccaaagcaatttcttaaccatcagccatgtgctgctatttctagggcttctgggctttgtcccttactgagagattagggactccacagctgccttgaggtagggcctggctgagagacaagggtagcagcaggtggcaggctgttaaaagacaggctgcctgaggagcctggagcaggtggaaacaggtggaagaaaccggccacagccctgctttaccgggctcacctctagggcattccagcaagaggctgatgcaggagaatggccagcaccaaaggacatttaaaagagtttttgggtttttttgtttgtttgttgttggtgtttgtttttttttttttttttttggcacacttgagctgactcagtgcaggtttaatatcctggtgacttgcagtcacattctaatgactttcaagggccagaatatggtgaaaatcacttaaaatatccgtcccttccatgccttagtttagcaggtaggctctatcttttgccatttctgtattttatgtgctgtgttcccgtttcactgggtatgaactgtgaaatcgactgaatcctggccactttatgagtttgtttggttttataaggcatttcaatgtacattctataaatacaagcactccatttgcaaacagatcttaagctaatattttctttcccattcatcttgccctccccctcctcccgccagctttaaagttcagtggagaagccagatggcaattcagacaaaggtatactcttcctgcttcatgggtggtggcacgggaatagatagcccttagccctttccctcccagtcccagctgagccctcagaccacttgcttcccacataacaatgtcgcctccatttccgaggaacatccttgcgtagagaatgaaatatgctgcaatcatttctgcatccttactcctcacccccaaagaaaaaaaaaaggcctagcagggaagcagcatgcaggcttcacagcttaatgccaaggacagcgagtgaggctgggagcttctcttgggcctgctgggtctgtcagctctcggaatagggacagtccttactggtgccccaaggtgggacttggagaatattttgcttggcatatgtttggtctgaatggtgtagttgctggttccctagagaggaaaaggtggcaggcccagctttgctgggaaatggctcttaatttccagttgaaaccctagtagaattgtgaatgaaaacctcaaggttgagcccctctgccaagcagcagagctagtagaaggggatgcaggggcaaagcactcagttgccaagcaaggaggagagatgtacgtgggctgtgtggcagtccccacaccctgccctggcttcttcaggttatcgcaccactatggaatcctttgcagaatggtactcatataatggtttaaaacaacacattcataattgactctgtgcaggatgtcactcaatcagtttgggtttgctttattttattttatatatatattttttggtatcctgtacattgcagtgggtgtgaagatagtattttaatatttgtacaaagtttaatttaattttaattgttctatgtatataactgcatttctaaataattaaaaaaaagttcttatgaaggc

SEQ ID NO: 187760 - DNA, 8174 bp, Homo sapiens
  Payload ID: 16954
  Gene Symbol: SNED1
  Gene Name: sushi, nidogen and EGF-like domains 1
  Uniprot ID: Q8TER0
  ENST ID: ENST00000310397
  CDS Start-End: 1-4242
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacaacccacagcctcggcgcagctcgagaacatggaggaagcccccaagcgggtcagcctggccctccagctccctgaacacggcagcaaggacatcggaaacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgtataaaagagtctaccgagttcaccaagacatctgcttcaaagagagctgtgaaagcacaagcctcaagaagaccccaaacaggaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatggaccacttccaaaacagagacgggggcaggggctgaagggcagagaccaggtgatgtcagaaggaaagccgggttgcagacacagccgcccctgctctggtcctccagcgtgtttatgacgctcgtgcaggtcgacgagccatcctatggactagttaacactaaggtggagttcagacttttttagacaacggcgcgactggcagcctttctctatcaagggtcagacggtaaacgttttcagctttgcagaccagaggtccctgtggctacagtagcgcagacacagccacaggcatgtcattgaatggctgcggctatgttccaataaaaacttatttacaataacaggtggtggccaaattggcccatgggccttatttggtgaaccctgttctatgagatcacctaggcttcagccttaaacagtggaagccatcccctgaatgacaagtcacaagggtatcaaagaaagacccctgaattttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccaccccacctcctctcgtgttgagcctcacgaccgctgacccagctggaaagccagcgccctgccgcgtcaccctgactctgctcagagccagcattccagccacaaagagggcctccttcctttcctctttcataaaaatgttttttgaagagttagagtatattttaggctttttatctttattaaaatttcatgtgcatgtgtctgtgtattctgcaatttgtcattttcagaaagaaggaacaggcaattcgcgaagtttcacctgtactcccgagctgttccccaggctccagacccacttgagagcagaaggtggagctcaatgaagggtctcgagctcagcgaagggtcactgggtgaactgagagaaaccacgttcacaaacgcgtactgcggacttcctgccgccctgggacctgtcactgtttgtccatgtaagctacagcattactagcagatgctaagatcgagtgatatcactggaaaagtaggtgaatcctactaggaaactttctactccctactaggacctcaagcccctcagccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagtgctgtcacaggacttgcccattgggatgttttccacattaaatatcaagtaaaaagacttcctggtgctcaggaattacagttcgttcttgaaacattccaaagaggccaccacagcttttcccatgtggcttcttttaaaaactcaaatggcttccttgaaaatactcaaagtccacccaaggaaattagtaataatagaatcagaaaactgtcaggagcataaagatttctgtatcaaaatgaaagaagcaatcctgagttgctgaattacccatctgctaatgaaaccgggatggactgatcatctaaccaagtgcagactgaggattctacttagtcctccgactgggtacaacaacagcctaggttctagggagggtggcagtgaccgggatgccacaatggaagagaaaatgaaaacactggcacagtgaaatgtctcatttccaaacagttttgcctatggccaagcaaggcaataaagacaaactctcccttttccccattgcgtgtgggctgccaggtacaagtaagggaatctttgctgtgcccactgtcctccagtagagaacccaacaggcaagggccccactcaggtatcagctcacctcctgcacctccccttagcaggaactccttccactggcaaaggactgccactgccatctgactcaactgtggcgatgtggacggagtcaccgagctgcttttcttttgcaaaacaaaagtctttttctttgcagtcacgctgtaagacgaggctgctggagaaaacaaaagcacctagatttcagtgctgaatccccacaattgcatgcagctcacacctaccaggggtattccagtgcataggggaaaggaacccggctgaaaaaccagctccttatttttcttttaaataaaataatacgatcctaagtccatttaccatctgaagttgtcacgagtgaacagtcacattactgttgtggaccaggccttagatgagtttctcaggctcagcactgacattctgggccggatcatcctctcttgtgggaccatcctgtgcactgcaggatgtttcacagcacccctggcctctacccactagaatcctacaatctaccagatcctaggatctagttgatcctagaatgctaccaaggagacttgaattttggtcccatcatcaaaaatgccttctgcatcaatcctatgccagtttcccctaaaagagggctaactggaatgttctaggatgtaccaatcctccaggaccctcttagagctcatgccatcagagacaggcctctatctcagggatcaccccggctgacatcaaattcctcttctcttttcccaacatttcaaattgttcttcggactcattgagttccctaaggtgacacgcccccccccccccccacacccaccttggggggtcacggattgctccctgtggccctggcttcagcccacctgctccatgaccctatgctcttctcctctggttctcgaagctgtctgtaaccagggcaggggagataactgtatgggaccattccctggcctccacctgccccagcactctccaggccagcacagtctggcactacagactacagggccggagacaccaggcttggaagtgaccactggccaagagctgacataaaagccaacttccccaaacaggaagggcctgttcttcacaaagataaagaaaactgccagcattttgctggccttaagaagccatgcaaaattaaccagtacatcatgaattaacttcttttactctgctgtgcactgaataccattatgaagcaatatacttttggattaaaaataagcatttttgtggaaaatctgctacatgttttcataaaataaagtgctatgatgtactaaaacctca

SEQ ID NO: 187761 - DNA, 1930 bp, Homo sapiens
  Payload ID: 16954
  Gene Symbol: SNED1
  Gene Name: sushi, nidogen and EGF-like domains 1
  ENST ID: ENST00000342631
  CDS Start-End: 134-1930
gtggggctttgccagcaggcagtggaggtggcacgcctcccgaggaggggtgggtttggggctgatggaagaaaaagcacatgtcctgagtagttgctcccagctgggaaaggggtaactgaagccccaggaaatgcacggaatcctgggggcatgtgggcgcctcagacttgagccagcaacacccttgacaccccttctctgtgcagagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgtataaaagagtctaccgagttcaccaagacatctgcttcaaagagagctgtgaaagcacaagcctcaag

SEQ ID NO: 187762 - DNA, 900 bp, Homo sapiens
  Payload ID: 16954
  Gene Symbol: SNED1
  Gene Name: sushi, nidogen and EGF-like domains 1
  ENST ID: ENST00000401644
  CDS Start-End: 1-900
cagcctgccccatgtttcagacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactg

SEQ ID NO: 187763 - DNA, 4538 bp, Homo sapiens
  Payload ID: 16954
  Gene Symbol: SNED1
  Gene Name: sushi, nidogen and EGF-like domains 1
  Uniprot ID: Q8TER0
  ENST ID: ENST00000401884
  CDS Start-End: 1-3975
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacaacccacagcctcggcgcagctcgagaacatggaggaagcccccaagcgggtcagcctggccctccagctccctgaacacggcagcaaggacatcggaagtgagtcagcagcgctggtggggactttgggactgactgactgctctcaggggccttagaggctgcaggcaggagggaccacccacggtgaggaatcaggaggcacagagcctacctgaggggaggctgagcaccaggcaccccggtgtgggaagatggggtgaagctacaccacccaagcagtgggaccccacagacgggaacaggccagggggcaggacccacccaaaccacccagagtctgagctagagagactggctttgatgctgcctcccctcccctctcctccttcgcctccacatgcagcagagcccaccccagcccctgcctctgggcccctcacccctcacttctccaaagaggagcaggcggagtcaggatgggagaagcagagggagcagccactgggcgagccccagcttgaggactagctgggccctgtggacactcaggttatgcaggacctgaactgtctcctagtccggggctctgcctcgtgaggatcgaggccagcacgtccctgcagggcaccaagcatctgctgagcacctgcagtaagagttcccagacgctcacgaggcagttccccttcgggcagcaccaatacatgtgtgttcctca

SEQ ID NO: 187764 - DNA, 7986 bp, Homo sapiens
  Payload ID: 16954
  Gene Symbol: SNED1
  Gene Name: sushi, nidogen and EGF-like domains 1
  Uniprot ID: Q8TER0
  ENST ID: ENST00000405547
  CDS Start-End: 1-4059
atgcggcacggcgtcgcctgggcgctgctggtggccgcggccctggggcttggggcgcgcggggtgcgcggcgcggtggcccttgccgacttctacccgttcggcgccgagcgcggcgacgccgtcacccccaagcaggacgacggcggctcggggctgcggccgctctcggtgcccttcccgttcttcggtgccgagcactccggactctacgtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaacgtccgtgtgcctggccctgcgcccctgcctcaacggcggcaagtgcatcgacgactgcgtcacgggcaacccctcctacacctgctcctgcctctcgggcttcacggggcggaggtgccacctggacgtgaacgaatgtgcctcccagccctgtcagaatggtgggacctgtactcacggcatcaacagtttccgctgccagtgcccggctggctttgggggacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaagcccggccacacctgtgcagctcagggccctgccggaacgggggcacgtgcaaggaggcgggcggcgagtaccactgcagctgcccctaccgcttcactgggaggcactgtgagatcgggaagccagactcgtgtgcctctggcccctgtcacaacggcggcacctgcttccactacattggcaaatacaagtgtgactgtcccccaggcttctccgggcggcactgcgagatagccccctccccctgcttccggagcccgtgtgtgaatgggggcacctgcgaggaccgggacacggatttcttctgccactgccaagcagggtacatgggacgccggtgccaggcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttgaaatcgatgagtgccggtctcagccgtgcctgcatgggggctcttgtcaggaccgcgttgctgggtacctgtgcctctgcagcacaggctatgagggcgcccactgtgagctggagagggatgagtgccgagctcacccgtgcagaaatggagggtcctgcaggaacctcccaggggcctatgtctgccggtgccctgcaggcttcgttggagtccactgtgagacagaggtggacgcctgcgactccagcccctgccagcatggaggccggtgtgagagcggcggcggggcctacctgtgcgtctgcccagagagcttcttcggctaccactgcgagacagtgagtgacccctgcttctccagcccctgtgggggccgtggctattgcctggccagcaacggctcccacagctgcacctgcaaagtgggctacacgggcgaggactgcgccaaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacagactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttagggccctgctgcctgggaagaggtacaccatccagctgaccaccctcagtgggctcaggggagaggagcaccccacagagagcctggccaccgcgccgacgcacgtgtggacccggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggttctcggagcttgtggacggcagaggaagagtgagcgccaggttcggtggctcacccagcaaagcagccaccgtgagatcacacgtccctggcaactgttcagaaaacccctgtcagaacggaggcacttgtgtgccgggcgcagacgcccacagctgtgactgcgggccagggttcaaaggcagacgctgcgagctcgcctgtataaaggtgtcccgcccctgcacaaggctgttctccgagacaaaggcctttccagtctgggagggaggcgtctgtcaccacgtgaaacaaagtaagagtcagacactggagaaatcttaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatggaccacttccaaaacagagacgggggcaggggctgaagggcagagaccaggtgatgtcagaaggaaagccgggttgcagacacagccgcccctgctctggtcctccagcgtgtttatgacgctcgtgcaggtcgacgagccatcctatggactagttaacactaaggtggagttcagacttttttagacaacggcgcgactggcagcctttctctatcaagggtcagacggtaaacgttttcagctttgcagaccagaggtccctgtggctacagtagcgcagacacagccacaggcatgtcattgaatggctgcggctatgttccaataaaaacttatttacaataacaggtggtggccaaattggcccatgggccttatttggtgaaccctgttctatgagatcacctaggcttcagccttaaacagtggaagccatcccctgaatgacaagtcacaagggtatcaaagaaagacccctgaattttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccaccccacctcctctcgtgttgagcctcacgaccgctgacccagctggaaagccagcgccctgccgcgtcaccctgactctgctcagagccagcattccagccacaaagagggcctccttcctttcctctttcataaaaatgttttttgaagagttagagtatattttaggctttttatctttattaaaatttcatgtgcatgtgtctgtgtattctgcaatttgtcattttcagaaagaaggaacaggcaattcgcgaagtttcacctgtactcccgagctgttccccaggctccagacccacttgagagcagaaggtggagctcaatgaagggtctcgagctcagcgaagggtcactgggtgaactgagagaaaccacgttcacaaacgcgtactgcggacttcctgccgccctgggacctgtcactgtttgtccatgtaagctacagcattactagcagatgctaagatcgagtgatatcactggaaaagtaggtgaatcctactaggaaactttctactccctactaggacctcaagcccctcagccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagtgctgtcacaggacttgcccattgggatgttttccacattaaatatcaagtaaaaagacttcctggtgctcaggaattacagttcgttcttgaaacattccaaagaggccaccacagcttttcccatgtggcttcttttaaaaactcaaatggcttccttgaaaatactcaaagtccacccaaggaaattagtaataatagaatcagaaaactgtcaggagcataaagatttctgtatcaaaatgaaagaagcaatcctgagttgctgaattacccatctgctaatgaaaccgggatggactgatcatctaaccaagtgcagactgaggattctacttagtcctccgactgggtacaacaacagcctaggttctagggagggtggcagtgaccgggatgccacaatggaagagaaaatgaaaacactggcacagtgaaatgtctcatttccaaacagttttgcctatggccaagcaaggcaataaagacaaactctcccttttccccattgcgtgtgggctgccaggtacaagtaagggaatctttgctgtgcccactgtcctccagtagagaacccaacaggcaagggccccactcaggtatcagctcacctcctgcacctccccttagcaggaactccttccactggcaaaggactgccactgccatctgactcaactgtggcgatgtggacggagtcaccgagctgcttttcttttgcaaaacaaaagtctttttctttgcagtcacgctgtaagacgaggctgctggagaaaacaaaagcacctagatttcagtgctgaatccccacaattgcatgcagctcacacctaccaggggtattccagtgcataggggaaaggaacccggctgaaaaaccagctccttatttttcttttaaataaaataatacgatcctaagtccatttaccatctgaagttgtcacgagtgaacagtcacattactgttgtggaccaggccttagatgagtttctcaggctcagcactgacattctgggccggatcatcctctcttgtgggaccatcctgtgcactgcaggatgtttcacagcacccctggcctctacccactagaatcctacaatctaccagatcctaggatctagttgatcctagaatgctaccaaggagacttgaattttggtcccatcatcaaaaatgccttctgcatcaatcctatgccagtttcccctaaaagagggctaactggaatgttctaggatgtaccaatcctccaggaccctcttagagctcatgccatcagagacaggcctctatctcagggatcaccccggctgacatcaaattcctcttctcttttcccaacatttcaaattgttcttcggactcattgagttccctaaggtgacacgcccccccccccccccacacccaccttggggggtcacggattgctccctgtggccctggcttcagcccacctgctccatgaccctatgctcttctcctctggttctcgaagctgtctgtaaccagggcaggggagataactgtatgggaccattccctggcctccacctgccccagcactctccaggccagcacagtctggcactacagactacagggccggagacaccaggcttggaagtgaccactggccaagagctgacataaaagccaacttccccaaacaggaagggcctgttcttcacaaagataaagaaaactgccagcattttgctggccttaagaagccatgcaaaattaaccagtacatcatgaattaacttcttttactctgctgtgcactgaataccattatgaagcaatatacttttggattaaaaataagcatttttgtggaaaatctgctacatgttttcataaaataaagtgctatgatgtactaaaa

SEQ ID NO: 187765 - DNA, 664 bp, Homo sapiens
  Payload ID: 16954
  Gene Symbol: SNED1
  Gene Name: sushi, nidogen and EGF-like domains 1
  ENST ID: ENST00000420591
  CDS Start-End: 1-201
cagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacagttgtgacttgttagaggaattaaaaggccaactggagattgcagcctacagtataaaaatggctttcgtgtctgattgttgcacctgcctccagaggctcacccactgtgccgacttctgtggacgcaccaggtgctgcttctctccagggagatgctaaagacaaactattcaggttatttttagtttaaaaaattcaggaggaaattctgttttacccgtaagacacagagggtcatgggccctccatcagtctttgccgagtgcatgggaggccagggtgtgtcctgaggggagggtggggcaggagcgggaggaggcagcctcacctatttggctgctttaaagtcactgttccgtgtcacagctcactttgcccagattgttatctaaatatcaatgtatttcactaaattcatgtcaggaaacggataagtggtttcaaaaattttttgcaaataaaccgtgttttctaca

SEQ ID NO: 187766 - DNA, 816 bp, Homo sapiens
  Payload ID: 16954
  Gene Symbol: SNED1
  Gene Name: sushi, nidogen and EGF-like domains 1
  ENST ID: ENST00000431690
  CDS Start-End: 1-816
gacccacctgtgagacagcccaatccccctgtgacaccaaagagtgtcaacatggtggccagtgccaggtggagaatggctctgcggtgtgtgtgtgccaggccggatacaccggagcagcctgcgagatggatgtggacgactgcagccctgacccctgcctgaatggaggctcttgtgttgacctagtggggaattacacctgcttgtgtgccgagcccttcaagggacttcgctgtgagacaggagaccatccagtgccagacgcctgcctctcggccccttgccacaatgggggcacctgtgtggatgcggaccagggctacgtgtgcgagtgccccgaaggcttcatgggcctggactgcagggagagagtccccgatgactgtgagtgccgcaacggaggcagatgcctgggcgccaacaccaccctctgccagtgccccctgggattctttgggcttctctgtgaatttgaaatcacagccatgccctgcaacatgaacacacagtgcccagatgggggctactgcatggagcacggcgggagctacctctgcgtctgccacaccgaccacaatgccagccactccctgccatcaccctgcgactcggacccctgcttcaacggaggctcctgcgatgcccatgacgactcctacacctgcgagtgcccgcgcgggttccacggcaagcactgcgagaaaggtatggcgggcaggggcgtccgggccggcgtcagcaccctggagagcgcccgcggtccgccgtcctgcttctctgctgtctctctccttgtttcgcgaattgctgacc

SEQ ID NO: 187767 - DNA, 3257 bp, Homo sapiens
  Payload ID: 16955
  Gene Symbol: SVEP1
  Gene Name: sushi, von Willebrand factor type A, EGF and pentraxin domain containing 1
  Uniprot ID: Q4LDE5
  ENST ID: ENST00000374461
  CDS Start-End: 338-2944
agggagagaaggagggaagcgggagatttttcttgactgccccctttccttcaaacattttataggcttcagggagagagaggaggaggagagagggaagaaaaaaagaggagagcgagaggggtagagagcgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggtaattaaattctgtggcatcggtagttggcaagactaatctgcaaaataagaataattccagaaaagtgaggcaaactagaaacattaacttctattaatttattcatcaagtattttaggatggctaaataatttgataatgtgctgaaagatcattaaggttatatcaaattttagtaacaaataaattatttaaaattatttgccaggattcttaaaaatgacaaaaactaagaaaactaagtcacatatgctggtaaaattcaaatgttgatgtatcctaaaagagaatagtaataaagtcctaacagcaactttt

SEQ ID NO: 187768 - DNA, 12194 bp, Homo sapiens
  Payload ID: 16955
  Gene Symbol: SVEP1
  Gene Name: sushi, von Willebrand factor type A, EGF and pentraxin domain containing 1
  Uniprot ID: Q4LDE5
  ENST ID: ENST00000374469
  CDS Start-End: 196-10911
ccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcagaacctataaaatgtaaggctccaggaaatccggaaaatggccactcctcaggtgagatttatacagtaggtgccgaagtcacattttcgtgtcaggaaggataccagttgatgggagtaaccaaaatcacatgtttggagtctggagaatggaatcatctaataccatattgtaaagctgtttcatgtggtaaaccggctattccagaaaatggttgcattgaggagttagcatttacttttggcagcaaagtgacatataggtgtaataaaggatatactctggccggtgataaagaatcatcctgtcttgctaacagttcttggagtcattcccctcctgtgtgtgaaccagtgaagtgttctagtccggaaaatataaataatggaaaatatattttgagtgggcttacctacctttctactgcatcatattcatgcgatacaggatacagcttacagggcccttccattattgaatgcacggcttctggcatctgggacagagcgccacctgcctgtcacctcgtcttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctactaaataatattttgctggatagtaccattttatgaggtggccaagggattcatagagaggactcatgatctttcatctgtgccactggcaccacataggagaccccttacaataaaggagacccctttgttctggttccatcttctatacaatatgtgtaataataaaagctttttctttcatttaatcaatcagagagtaactgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacaaagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagccttccccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaa

SEQ ID NO: 187769 - DNA, 12350 bp, Homo sapiens
  Payload ID: 16955
  Gene Symbol: SVEP1
  Gene Name: sushi, von Willebrand factor type A, EGF and pentraxin domain containing 1
  ENST ID: ENST00000401783
  CDS Start-End: 338-11062
agggagagaaggagggaagcgggagatttttcttgactgccccctttccttcaaacattttataggcttcagggagagagaggaggaggagagagggaagaaaaaaagaggagagcgagaggggtagagagcgcgcgccgttccctccggagttcccgagctgctgaggagtctggattgtgtctgtccccagtgtcagatgaaagggcgctgaggctcttggccgctgccccgcgcccagctccgcgcacgcccctctgcgagtccggccgcccagcgcctcttcccgcccgagccgccgcctgcgctccggggcagccgctctgtctccagcgcgatgtggcctcgcctggccttttgttgctggggtctggcgctcgtttcgggctgggcgacctttcagcagatgtccccgtcgcgcaatttcagcttccgcctcttccccgagaccgcgcccggggcccccgggagtatccccgcgccgcccgctcctggcgacgaagcggcggggagcagagtggagcggctgggccaggcgttccggcgacgcgtgcggctgctgcgggagctcagcgagcgcctggagcttgtcttcctggtggatgattcgtccagcgtgggcgaagtcaacttccgcagcgagctcatgttcgtccgcaagctgctgtccgacttccccgtggtgcccacggccacgcgcgtggccatcgtgaccttctcgtccaagaactacgtggtgccgcgcgtcgattacatctccacccgccgcgcgcgccagcacaagtgcgcgctgctcctccaagagatccctgccatctcctaccgaggtggcggcacctacaccaagggcgccttccagcaagccgcgcaaattcttcttcatgctagagaaaactcaacaaaagttgtatttctcatcactgatggatattccaatgggggagaccctagaccaattgcagcgtcactgcgagattcaggagtggagatcttcacttttggcatatggcaagggaacattcgagagctgaatgacatggcttccaccccaaaggaggagcactgttacctgctacacagttttgaagaatttgaggctttagctcgccgggcattgcatgaagatctaccttctgggagttttattcaagatgatatggtccactgctcatatctttgtgatgaaggcaaggactgctgtgaccgaatgggaagctgcaaatgtgggacacacacaggccattttgagtgcatctgtgaaaaggggtattacgggaaaggtctgcagtatgaatgcacagcttgcccatcggggacatacaaacctgaaggctcaccaggaggaatcagcagttgcattccatgtcctgatgaaaatcacacctctccacctggaagcacatcccctgaagactgtgtctgcagagagggatacagggcatctggccagacctgtgaacttgtccactgccctgccctgaagcctcccgaaaatggttactttatccaaaacacttgcaacaaccacttcaatgcagcctgtggggtccgatgtcaccctggatttgatcttgtgggaagcagcatcatcttatgtctacccaatggtttgtggtccggttcagagagctactgcagagtaagaacatgtcctcatctccgccagccgaaacatggccacatcagctgttctacaagggaaatgttatataagacaacatgtttggttgcctgtgatgaagggtacagactagaaggcagtgataagcttacttgtcaaggaaacagccagtgggatgggccagaaccccggtgtgtggagcgccactgttccacctttcagatgcccaaagatgtcatcatatccccccacaactgtggcaagcagccagccaaatttgggacgatctgctatgtaagttgccgccaagggttcattttatctggagtcaaagaaatgctgagatgtaccacttctggaaaatggaatgtcggagttcaggcagctgtgtgtaaagacgtggaggctcctcaaatcaactgtcctaaggacatagaggctaagactctggaacagcaagattctgccaatgttacctggcagattccaacagctaaagacaactctggtgaaaaggtgtcagtccacgttcatccagctttcaccccaccttaccttttcccaattggagatgttgctatcgtatacacggcaactgacctatccggcaaccaggccagctgcattttccatatcaaggttattgatgcagaaccacctgtcatagactggtgcagatctccacctcccgtccaggtctcggagaaggtacatgccgcaagctgggatgagcctcagttctcagacaactcaggggctgaattggtcattaccagaagtcatacacaaggagaccttttccctcaaggggagactatagtacagtatacagccactgacccctcaggcaataacaggacatgtgatatccatattgtcataaaaggttctccctgtgaaattccattcacacctgtaaatggggattttatatgcactccagataatactggagtcaactgtacattaacttgcttggagggctatgatttcacagaagggtctactgacaagtattattgtgcttatgaagatggcgtctggaaaccaacatataccactgaatggccagactgtgccaaaaaacgttttgcaaaccacgggttcaagtcctttgagatgttctacaaagcagctcgttgtgatgacacagatctgatgaagaagttttctgaagcatttgagacgaccctgggaaaaatggtcccatcattttgtagtgatgcagaggacattgactgcagactggaggagaacctgaccaaaaaatattgcctagaatataattatgactatgaaaatggctttgcaattggaccaggtggctggggtgcagctaataggctggattactcttacgatgacttcctggacactgtgcaagaaacagccacaagcatcggcaatgccaagtcctcacggattaaaagaagtgccccattatctgactataaaattaagttaatttttaacatcacagctagtgtgccattacccgatgaaagaaatgatacccttgaatgggaaaatcagcaacgactccttcagacattggaaactatcacaaataaactgaaaaggactctcaacaaagaccccatgtattcctttcagcttgcatcagaaatacttatagccgacagcaattcattagaaacaaaaaaggcttcccccttctgcagaccaggctcagtgctgagagggcgtatgtgtgtcaattgccctttgggaacctattataatctggaacatttcacctgtgaaagctgccggatcggatcctatcaagatgaagaagggcaacttgagtgcaagctttgcccctctgggatgtacacggaatatatccattcaagaaacatctctgattgtaaagctcagtgtaaacaaggcacctactcatacagtggacttgagacttgtgaatcgtgtccactgggcacttatcagccaaaatttggttcccggagctgcctctcgtgtccagaaaacacctcaactgtgaaaagaggagccgtgaacatttctgcatgtggagttccttgtccagaaggaaaattctcgcgttctgggttaatgccctgtcacccatgtcctcgtgactattaccaacctaatgcagggaaggccttctgcctggcctgtcccttttatggaactaccccattcgctggttccagatccatcacagaatgttcaagttttagttcaactttctcagcggcagaggaaagtgtggtgccccctgcctctcttggacatattaaaaagaggcatgaaatcagcagtcaggttttccatgaatgcttctttaacccttgccacaatagtggaacctgccagcaacttgggcgtggttatgtttgtctctgtccacttggatatacaggcttaaagtgtgaaacagacatcgatgagtgcagcccactgccttgcctcaacaatggagtttgtaaagacctagttggggaattcatttgtgagtgcccatcaggttacacaggtcagcggtgtgaagaaaatataaatgagtgtagctccagtccttgtttaaataaaggaatctgtgttgatggtgtggctggctatcgttgcacatgtgtgaaaggatttgtaggcctgcattgtgaaacagaagtcaatgaatgccagtcaaacccatgcttaaataatgcagtctgtgaagaccaggttgggggattcttgtgcaaatgcccacctggatttttgggtacccgatgtggaaagaacgtcgatgagtgtctcagtcagccatgcaaaaatggagctacctgtaaagacggtgccaatagcttcagatgcctgtgtgcagctggcttcacaggatcacactgtgaattgaacatcaatgaatgtcagtctaatccatgtagaaatcaggccacctgtgtggatgaattaaattcatacagttgtaaatgtcagccaggattttcaggcaaaaggtgtgaaacagaacagtctacaggctttaacctggattttgaagtttctggcatctatggatatgtcatgctagatggcatgctcccatctctccatgctctaacctgtaccttctggatgaaatcctctgacgacatgaactatggaacaccaatctcctatgcagttgataacggcagcgacaataccttgctcctgactgattataacggctgggttctttatgtgaatggcagggaaaagataacaaactgtccctcggtgaatgatggcagatggcatcatattgcaatcacttggacaagtgccaatggcatctggaaagtctatatcgatgggaaattatctgacggtggtgctggcctctctgttggtttgcccatacctggtatgttaggtggtggtgcgttagttctggggcaagagcaagacaaaaaaggagagggattcagcccagctgagtcttttgtgggctccataagccagctcaacctctgggactatgtcctgtctccacagcaggtgaagtcactggctacctcctgcccagaggaactcagtaaaggaaacgtgttagcatggcctgatttcttgtcaggaattgtggggaaagtgaagatcgattctaagagcatattttgttctgattgcccacgcttaggagggtcagtgcctcatctgagaactgcatctgaagatttaaagccaggttccaaagtcaatctgttctgtgatccaggcttccagctggtcgggaaccctgtgcagtactgtctgaatcaaggacagtggacacaaccacttcctcactgtgaacgcattagctgtggggtgccacctcctttggagaatggcttccattcagccgatgacttctatgctggcagcacagtaacctaccagtgcaacaatggctactatctattgggtgactcaaggatgttctgtacagataatgggagctggaacggcgtttcaccatcctgccttgatgtcgatgagtgtgcagttggatcagattgtagtgagcatgcttcttgcctgaacgtagatggatcctacatatgttcatgtgtcccaccgtacacaggagatgggaaaaactgtgcagaacctataaaatgtaaggctccaggaaatccggaaaatggccactcctcaggtgagatttatacagtaggtgccgaagtcacattttcgtgtcaggaaggataccagttgatgggagtaaccaaaatcacatgtttggagtctggagaatggaatcatctaataccatattgtaaagctgtttcatgtggtaaaccggctattccagaaaatggttgcattgaggagttagcatttacttttggcagcaaagtgacatataggtgtaataaaggatatactctggccggtgataaagaatcatcctgtcttgctaacagttcttggagtcattcccctcctgtgtgtgaaccagtgaagtgttctagtccggaaaatataaataatggaaaatatattttgagtgggcttacctacctttctactgcatcatattcatgcgatacaggatacagcttacagggcccttccattattgaatgcacggcttctggcatctgggacagagcgccacctgcctgtcacctcgtcttctgtggagaaccacctgccatcaaagatgctgtcattacggggaataacttcactttcaggaacaccgtcacttacacttgcaaagaaggctatactcttgctggtcttgacaccattgaatgcctggccgacggcaagtggagtagaagtgaccagcagtgcctggctgtctcctgtgatgagccacccattgtggaccacgcctctccagagactgcccatcggctctttggagacattgcattctactactgctctgatggttacagcctagcagacaattcccagcttctctgcaatgcccagggcaagtgggtacccccagaaggtcaagacatgccccgttgtatagctcatttctgtgaaaaacctccatcggtttcctatagcatcttggaatctgtgagcaaagcaaaatttgcagctggctcagttgtgagctttaaatgcatggaaggctttgtactgaacacctcagcaaagattgaatgtatgagaggtgggcagtggaacccttcccccatgtccatccagtgcatccctgtgcggtgtggagagccaccaagcatcatgaatggctatgcaagtggatcaaactacagttttggagccatggtggcttacagctgcaacaaggggttctacatcaaaggggaaaagaagagcacctgcgaagccacagggcagtggagtagtcctataccgacgtgccacccggtatcttgtggtgaaccacctaaggttgagaatggctttctggagcatacaactggcaggatctttgagagtgaagtgaggtatcagtgtaacccgggctataagtcagtcggaagtcctgtatttgtctgccaagccaatcgccactggcacagtgaatcccctctgatgtgtgttcctctcgactgtggaaaacctcccccgatccagaatggcttcatgaaaggagaaaactttgaagtagggtccaaggttcagtttttctgtaatgagggttatgagcttgttggtgacagttcttggacatgtcagaaatctggcaaatggaataagaagtcaaatccaaagtgcatgcctgccaagtgcccagagccgcccctcttggaaaaccagctagtattaaaggagttgaccaccgaggtaggagttgtgacattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaaaatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcaggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcacgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgtacatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctctaccctcacaaaatgtacatattctgctgtctattgggaaagttcctggtacacatttttattcagttacttaaaatgatttttccattaaagtatattttgctactaaataatattttgctggatagtaccattttatgaggtggccaagggattcatagagaggactcatgatctttcatctgtgccactggcaccacataggagaccccttacaataaaggagacccctttgttctggttccatcttctatacaatatgtgtaataataaaagctttttctttcatttaatcaatcagagagtaactgttggacctggtactctccaccacataattatgtcctggtacttagggtagcctggctaattcttttcacaacatttgaaaagccgtaggcattaacttcatggatgtggagaaacagcataatgaccttggttcacaatgaaagtgctagccttctttctcgtggctggaataagaaatgcaagaactggaagattaacaaagagctgatacccggactggtaatcccacaactcactattttgggaggaaggggaagacagggaaagagaaggaaaaaggcaaatgggaaacattccccagagctgtgctcctggtctcacctgcaaaaaagaattgcagccacctaagagaaagctgagctgcccctcagtcctcactgtcacctacctctatcacaacaattgtaccaagatgaagccttccccagacttcagaaaataaagtcaaaccctagattttgttttaaaataggaaactcagaatcaacttgcctccatcctctgggaaaactgctcccacacaggccttggagtgtgttgtagcactgtggaggaatgcagaaaggatgaaagagatcttgattctcctagtggttctcttcactaccgtaggcatccctcagccattgactcctccttctttctcttgacattcactttcttggccagtcttacatgcttatgagtctactttccaataaatttactcatagtccattaacttcc

SEQ ID NO: 187770 - DNA, 1874 bp, Homo sapiens
  Payload ID: 16956
  Gene Symbol: SRPX
  Gene Name: sushi-repeat containing protein, X-linked
  Uniprot ID: P78539
  ENST ID: ENST00000378533
  CDS Start-End: 108-1502
cccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaa

SEQ ID NO: 187771 - DNA, 1725 bp, Homo sapiens
  Payload ID: 16956
  Gene Symbol: SRPX
  Gene Name: sushi-repeat containing protein, X-linked
  Uniprot ID: P78539
  ENST ID: ENST00000432886
  CDS Start-End: 133-1350
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 187772 - DNA, 1842 bp, Homo sapiens
  Payload ID: 16956
  Gene Symbol: SRPX
  Gene Name: sushi-repeat containing protein, X-linked
  Uniprot ID: P78539
  ENST ID: ENST00000544439
  CDS Start-End: 133-1467
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcagcaagcacagtgtggccttgatcttcgacacatcaccgtggtggagctggtgggtgtgttcccgactctcattggcaggataggagcaaagattatgcctccagccctagcgctgcagctcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 187773 - DNA, 1780 bp, Homo sapiens
  Payload ID: 16956
  Gene Symbol: SRPX
  Gene Name: sushi-repeat containing protein, X-linked
  Uniprot ID: P78539
  ENST ID: ENST00000538295
  CDS Start-End: 133-1272
agaggcgagaggaggagttttccagcccggccttcgcccgcccgctagcacgcagtcccttggtctcttcggtctcctgccgcccccgggaagcgcgctgcgctgccgaggcgagctaagcgcccgctcgccatggggagccccgcacatcggcccgcgctgctgctgctgctgccgcctctgctgctgctgctgctgctgcgcgtcccgcccagccgcagcttcccaggatcgggagactcaccactagaagacgatgaagtcgggtattcacaccctagatataaagataccccgtggtgctcccccatcaaggtgaagtatggggatgtgtactgcagggcccctcaaggaggatactacaaaacagccctgggaaccaggtgcgacattcgctgccagaagggctacgagctgcatggctcttccctactgatctgccagtcaaacaaacgatggtctgacaaggtcatctgcaaacaaaagcgatgtcctacccttgccatgccagcaaatggagggtttaagtgtgtagatggtgcctactttaactcccggtgtgagtattattgttcaccaggatacacgttgaaaggggagcggaccgtcacatgtatggacaacaaggcctggagcggccggccagcctcctgtgtggatatggaacctcctagaatcaagtgcccaagtgtgaaggaacgcattgcagaacccaacaaactgacagtccgggtgtcctgggagacacccgaaggaagagacacagcagatggaattcttactgatgtcattctaaaaggcctccccccaggctccaactttccagaaggagaccacaagatccagtacacagtctatgacagagctgagaataagggcacttgcaaatttcgagttaaagtaagagtcaaacgctgtggcaaactcaatgccccagagaatggttacatgaagtgctccagcgacggtgataattatggagccacctgtgagttctcctgcatcggcggctatgagctccagggtagccctgcccgagtatgtcaatccaacctggcttggtctggcacggagcccacctgtgcagccatgaacgtcaatgtgggtgtcagaacggcagctgcacttctggatcagttttatgagaaaaggagactcctcattgtgtccacacccacagcccgaaacctcctttaccggctccagctaggaatgctgcaggctgttgctgcgaatcccactctactccttcagtatggtgctagtggataagcatggcatggacaaagagcgctatgtctccctggtgatgcctgtggccctgttcaacctgattgacacttttcccttgagaaaagaagagatggtcctacaagccgaaatgagccagacctgtaacacctgacatgatggttcctctcttggcaattcctcttcattgtctacatagtgacatgcacacgggaaagccttaaaaatatccttgatgtacagattttatttgtaattttaaaagtctattttattatgagctttctttgcacttaaaaattagcatgctgctttttgtacttggaagtgtttcaaaaaattatatgaccatatttactctttctaactttctttactccatcatggctgcttgattttgtagagaaattagaacccataaccatacacaggctatcaacatgttattcaatgtgacacctaactcttttctattttgttttttaagtaagacttttattaataaaacaaaatgttttggagcaaattt

SEQ ID NO: 187774 - DNA, 2138 bp, Homo sapiens
  Payload ID: 16957
  Gene Symbol: SRPX2
  Gene Name: sushi-repeat containing protein, X-linked 2
  Uniprot ID: O60687
  ENST ID: ENST00000373004
  CDS Start-End: 429-1826
agcagacggactgagttcctctaatccctgtgttccttctcccccatctttctaaaacccttctctgagagaggaataactatagcttcagggataatatagctttaaggaaacttttggcagatgtggacgtcgtaacatctgggcagtgttaacagaatcccggaggccgggacagaccaggagccactcgttctaggaatgttaaagtagaaggttttttccaattgatgagaggagcagagaggaaggagaaagaggaggagagagaaaaagggcacaaaataccataaaacagatcccatatttctgcttcccctcacttttagaagttaattgatggctgacttctgaaagtcactttcctttgccctggtacttcaggccatatacatcttttcttgtctccataatcctccctttcaaggatggccagtcagctaactcaaagaggagctctctttctgctgttcttcctaactccggcagtgacaccaacatggtatgcaggttctggctactatccggatgaaagctacaatgaagtatatgcagaggaggtcccacaggctcctgccctggactaccgagtcccccgatggtgttatacattaaatatccaggatggagaagccacatgctactcaccgaagggaggaaattatcacagcagcctgggcacgcgttgtgagctctcctgtgaccggggctttcgattgattggaaggaggtcggtgcaatgcctgccaagccgtcgttggtctggaactgcctactgcaggcagatgagatgccacgcactaccattcatcactagtggcacttacacctgcacaaatggagtgcttcttgactctcgctgtgactacagctgttccagtggctaccacctggaaggtgatcgcagccgaatctgcatggaagatgggagatggagtggaggcgagcctgtatgtgtagacatagatccccccaagatccgctgtccccactcacgtgagaagatggcagagccagagaaattgactgctcgagtatactgggacccaccgttggtgaaagattctgctgatggtaccatcaccagggtgacacttcggggccctgagcctggctctcactttcccgaaggagagcatgtgattcgttacactgcctatgaccgagcctacaaccgggccagctgcaagttcattgtgaaagtacaagtgagacgctgcccaactctgaaacctccgcagcacggctacctcacctgcacctcagcgggggacaactatggtgccacctgtgaataccactgtgatggcggttatgatcgccaggggacaccctcccgggtctgtcagtccagccgccagtggtcaggttcaccaccaatctgtgctcctatgaagattaacgtcaacgtcaactcagctgctggtctcttggatcaattctatgagaaacagcgactcctcatcatctcagctcctgatccttccaaccgatattataaaatgcagatctctatgctacagcaatccacctgtggactggatttgcggcatgtgaccatcattgaactggtgggacagccacctcaggaggtggggcgcatccgggagcaacagctgtcagccaacatcatcgaggagctcaggcaatttcagcgcctcactcgctcctacttcaacatggtgttgattgacaagcagggtattgaccgagaccgctacatggaacctgtcacccccgaggaaatcttcacattcattgatgactacctactgagcaatcaggagttgacccagcgtcgggagcaaagggacatatgcgagtgaacttgagccagggcatggttaaagtcaagggaaaagctcctctagttagctgaaactgggacctaataaaaggaggaaatgttttcccacagttctagggacaggactctgaggtgggtgagtttgacaaatcctgcggtgtttccaggcatccttttaggactgtgtaatagtttccctagaagctaggtagggactgaggacaggccttgggcagtgggttgggggtagaagttcttcctttcctaacccgggcccctgcccagctctccaaagtctttcagaaaagtaaatcctaaattcagtgatgaa

SEQ ID NO: 187775 - DNA, 2484 bp, Homo sapiens
  Payload ID: 16958
  Gene Symbol: SUPV3L1
  Gene Name: SUV3-like helicase
  Uniprot ID: Q8IYB8
  ENST ID: ENST00000359655
  CDS Start-End: 61-2421
gcgtcactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtaaagaaggtcttagacaaattttacaagaggaaagaaattcagaaactgggtgctgattatggacttgatgctcgtctcttccaccaagctttcataagctttagaaattatattatgcagtctcattccctggatgtggacattcacattgttttgaatgatatttgcttcggtgcagctcatgcggatgatttattcccatttttcttgagacatgccaaacaaatatttcctgtgttggactgtaaggatgatctacgtaaaatcagtgacttaagaataccacctaactggtacccagatgctagagccatgcagcggaagataatatttcattcaggccccacaaacagtggaaagacttatcacgcaatccagaaatacttctcagcaaagtctggagtgtattgtggccctctaaaattactggcacatgagatcttcgaaaagagtaatgctgctggtgtgccatgtgacttggtgacaggtgaagagcgtgtgacagttcagccaaatgggaaacaggcttcacatgtttcttgtacagttgagatgtgcagtgttacaactccttatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaaccaatcacaacctctcaagccctgcagattgctggcagagctggcagattcagctcacggtttaaagaaggagaggttacaacaatgaatcatgaagatctcagtttattaaaggaaattttgaagaggcctgtggatcctataagggcagctggtcttcatccaactgctgagcagattgaaatgtttgcctaccatctccctgatgcaacactgtccaatctcattgatatttttgtagacttttcacaagttgatgggcagtattttgtctgcaatatggatgattttaaattttctgcagagttgatccagcatattccactaagtctgcgagtgaggtatgttttctgcacagctcctatcaacaagaagcagccttttgtgtgttcttcactgttacagtttgccaggcagtatagcaggaatgagcccctgacctttgcatggttacgccgatacatcaaatggcctttacttccacctaagaatattaaagacctcatggatcttgaagctgtccacgatgtcttggatctttacttgtggctaagctaccgatttatggatatgtttccagatgccagccttattcgagatctccagaaagaactagatggtattatccaagatggtgtgcacaatatcactaaattgattaaaatgtctgagacgcataagctgttgaatttggagggctttccatcagggagccagtcacgattgtcaggaaccttaaagagccaagctagaaggacacgcggcaccaaagctctagggagtaaagctactgagccacccagccccgatgcaggagagctgtcccttgcttccagattggtgcagcaaggactcctcactccagacatgctgaaacagctagaaaaagagtggatgacacaacaaactgaacacaacaaagaaaaaacagagtctgggactcatccaaaagggacgagaagaaagaagaaggaacctgattcggactagttttctgttcctgtttttttttttttatttaattttgcaaataaaaatttattttgaatcctt

SEQ ID NO: 187776 - DNA, 794 bp, Homo sapiens
  Payload ID: 16958
  Gene Symbol: SUPV3L1
  Gene Name: SUV3-like helicase
  ENST ID: ENST00000422378
  CDS Start-End: 5-794
ctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagaatgaagtggctgtaattgatgaaattcaaatgattagagatccagccagaggatgggcctggaccagagcacttctaggactgtgtgctgaagaggttcatttgtgtggagaacctgctgctattgacctggtgatggagcttatgtacacaacgggggaggaagtggaggttcgagactataagaggcttacccccatttctgtgctggaccatgcactagaatctttagataaccttcggcctggggactgcattgtctgttttagcaagaatgatatttattctgtgagtcggcagattgaaattcggggattagaatcagctgttatatatggcagtctcccacctgggaccaaacttgctcaagcaaaaaagtttaatgatcccaatgacccatgcaaaatcttggttgctacagatgcaattggcatgggacttaatttgagcataaggagaattattttttactcccttataaagcccagtatcaatgaaaagggagagagagaactagaac

SEQ ID NO: 187777 - DNA, 3636 bp, Homo sapiens
  Payload ID: 16959
  Gene Symbol: SZRD1
  Gene Name: SUZ RNA binding domain containing 1
  Uniprot ID: Q7Z422
  ENST ID: ENST00000401088
  CDS Start-End: 176-634
cttccaagatggctgccctaatgtacacttgggaccttgcctggcgcctcttccgggcttggcagcgggcggggtccattgagtaaagccttgcgtgcctgcgcccgcgacggaggcgcgcttcaaagcgcaggcgcggggagggggtgggggaggagggaaagcggcgagtaagatggaagatgaggaggtcgctgagagctgggaagaggcggcagacagcggggaaatagacagacggttggaaaaaaaactgaagatcacacaaaaagagagcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 187778 - DNA, 3447 bp, Homo sapiens
  Payload ID: 16959
  Gene Symbol: SZRD1
  Gene Name: SUZ RNA binding domain containing 1
  Uniprot ID: Q7Z422
  ENST ID: ENST00000401089
  CDS Start-End: 41-442
gggggtgggggaggagggaaagcggcgagtaagatggaagatgaggaggtcgctgagagctgggaagaggcggcagacagcgggcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttgtca

SEQ ID NO: 187779 - DNA, 3401 bp, Homo sapiens
  Payload ID: 16959
  Gene Symbol: SZRD1
  Gene Name: SUZ RNA binding domain containing 1
  Uniprot ID: Q7Z422
  ENST ID: ENST00000492354
  CDS Start-End: 1-399
atgaggaggtcgctgagagctgggaagaggcggcagacagcggggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttg

SEQ ID NO: 187780 - DNA, 892 bp, Homo sapiens
  Payload ID: 16959
  Gene Symbol: SZRD1
  Gene Name: SUZ RNA binding domain containing 1
  Uniprot ID: Q7Z422
  ENST ID: ENST00000471507
  CDS Start-End: 171-626
aagatggctgccctaatgtacacttgggaccttgcctggcgcctcttccgggcttggcagcgggcggggtccattgagtaaagccttgcgtgcctgcgcccgcgacggaggcgcgcttcaaagcgcaggcgcggggagggggtgggggaggagggaaagcggcgagtaagatggaagatgaggaggtcgctgagagctgggaagaggcggcagacagcggggaaatagacagacggttggaaaaaaaactgaagatcacacaaaaagagaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaa

SEQ ID NO: 187781 - DNA, 567 bp, Homo sapiens
  Payload ID: 16959
  Gene Symbol: SZRD1
  Gene Name: SUZ RNA binding domain containing 1
  ENST ID: ENST00000476423
  CDS Start-End: 23-277
aaagcggcgagtaagatggaagatgaggaggtcgctgagagctgggaagaggcggcagacagcgggatctggccctgtctgccaaagcttgttggccgtcattaggcagggcaagtgctctttggtgccctgcagccccttcacttccccaggtatgctccgtgcgagtggagtttggctgcttgcctggtctatgaaggcatttggtctcaaccctcaaaggcttctaaattctacagctgtcaaggctctgtttatgatggagaaactcgaataggcagtcttgtatttagagtggagcgaaatgatacagtatgaaactttaaaacaagaagttacttgtgagaagcccttaaaaggaaatagacagacggttggaaaaaaaactgaagatcacacaaaaagagagcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagt

SEQ ID NO: 187782 - DNA, 4491 bp, Homo sapiens
  Payload ID: 16960
  Gene Symbol: SUZ12
  Gene Name: SUZ12 polycomb repressive complex 2 subunit
  Uniprot ID: Q15022
  ENST ID: ENST00000322652
  CDS Start-End: 230-2449
agggtagggtgagcggcctccgaagcggagcggggctctgaggagacactttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaagattattttaggggagatgtaggtgtagaattattgcttatgtcatttcttaagcagttatgctcttaatgcttaaaagaaggctagcattgtttgcacaaaaagttggtgattcccaccccaaatagtaataaaattacttctgttgagtaaactttttatgtcatcgtaaaagctgaaaaaatccctttgtttctatttataaaaaaagtgcttttctatatgtacccttgataacagattttgaagaaatcctgtaagatgataaagcatttgaatggtacagtagatgtaaaaaaaattcagtttaaaagaacatttgtttttacattaaatgtttatttgaaatcaaatgattttgtacataaagttcaataatataaaagctgtattctg

SEQ ID NO: 187783 - DNA, 3977 bp, Homo sapiens
  Payload ID: 16960
  Gene Symbol: SUZ12
  Gene Name: SUZ12 polycomb repressive complex 2 subunit
  ENST ID: ENST00000580398
  CDS Start-End: 181-2331
tttttttttcctccctccttccctcctctcctcctcccttcccttcccctctcctcccctctctcctccttcccccctcggtccgccggagcctgctggggcgagcggttggtattgcaggcgcttgctctccggggccgcccggcgggtagctggcggggggaggaggcaggaaccgcgatggcgcctcagaagcacggcggtgggggagggggcggctcggggcccagcgcggggtccgggggaggcggcttcgggggttcggcggcggtggcggcggcgacggcttcgggcggcaaatccggcggcgggagctgtggagggggtggcagttactcggcctcctcctcctcctccgcggcggcagcggcgggggctgcggtgttaccggtgaagaagccgaaaatggagcacgtccaggctgaccacgagcttttcctccaggcctttgagaagccaacacagatctatagatttcttcgaactcggaatctcatagcaccaatatttttgcacagaactcttacttacatgtctcatcgaaactccagaacaaacatcaaaagcttgtcagctcatttgcagcttacgtttactggtttcttccacaaaaatgataagccatcaccaaactcagaaaatgaacaaaattctgttaccctggaagtcctgcttgtgaaagtttgccacaaaaaaagaaaggatgtaagttgtccaataaggcaagttcccacaggtaaaaagcaggtgcctttgaatcctgacctcaatcaaacaaaacccggaaatttcccgtcccttgcagtttccagtaatgaatttgaacctagtaacagccatatggtgaagtcttactcgttgctatttagagtgactcgtccaggaagaagagagtttaatggaatgattaatggagaaaccaatgaaaatattgatgtcaatgaagagcttccagccagaagaaaacgaaatcgtgaggatggggaaaagacatttgttgcacaaatgacagtatttgataaaaacaggcgcttacagcttttagatggggaatatgaagtagccatgcaggaaatggaagaatgtccaataagcaagaaaagagcaacatgggagactattcttgatgggaagaggctgcctccattcgaaacattttctcagggacctacgttgcagttcactcttcgttggacaggagagaccaatgataaatctacggctcctattgccaaacctcttgccactagaaattcagagagtctccatcaggaaaacaagcctggttcagttaaacctactcaaactattgctgttaaagaatcattgactacagatctacaaacaagaaaagaaaaggatactccaaatgaaaaccgacaaaaattaagaatattttatcagtttctctataacaacaatacaaggcaacaaactgaagcaagagatgacctgcattgcccttggtgtactctgaactgccgcaaactttatagtttactcaagcatcttaaactctgccatagcagatttatcttcaactatgtttatcatccaaaaggtgctaggatagatgtttctatcaatgagtgttatgatggctcctatgcaggaaatcctcaggatattcatcgccaacctggatttgcttttagtcgcaacggaccagttaagagaacacctatcacacatattcttgtgtgcaggccaaaacgaacaaaagcaagcatgtctgaatttcttgaatctgaagatggggaagtagaacagcaaagaacatatagtagtggccacaatcgtctgtatttccatagtgatacctgcttacctctccgtccacaagaaatggaagtagatagtgaagatgaaaaggatcctgaatggctaagagaaaaaaccattacacaaattgaagagttttctgatgttaatgaaggagagaaagaagtgatgaaactctggaatctccatgtcatgaagcatgggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatgaaaagcaatatttcaaagtatttttaaactcaacaaatgtcatcaaatatgttgaattgatctagaaattatttcatatataaatcagaatttttttgcatttatgaacggctgtttttctactttgtaattgtgagacattttcttggggagggaaaattggaatggttcccttttttagaaattgaagtggtcttcatatgtcaactacagaaaaggaaaaaaatagaaattgaaggatttttatgaaattatattgcattactatttgcagtcaaactttgatccttgtttttgaaatcatttgtcaattcggaatgaaaaattataatgtaattttacattacataagttccttttacaattaaaaaatagcacttcttcatcttatgcctgtttgagaagatattaaattttcacattgttgacagtgaaatgctatgttggtttataagattacagaccatttgttttcatgtggataattttagtgcattgctcacccggtatgttttttttttttaacttgaacattttgcttgttttgtttttcttttttaattagataatcacacggaaaattaagctgttcatatctttaaattaggattgcaaaccaaggaaagaacgcatttgagattttaagatgtcacttataaggggagaagtgttcttaaaaagtcaaccagaaaactgttatgccttttatttgtttgcaaggatgtctttgtaatgtgtttcatgaatagaatatccaatagagataagctgacttgaatcattttgagcaattttgccctgtgttatatgtgtttcacgcacatatttgcagttggattttctccaacagaaagtggattcactactggcacattaacaagcaccaataggtttttattccaactccgagcactgtggttgagtaacatcacctcaattttttattatccttaaagatattgcattttcatattctttatttataaaggatcaatgctgctgtaaatacaggtatttttaattttaaaatttcattccaccaccatcagatgcagttccctattttgtttaatgaagggatatataagctttctaatggtgtcttcagaaatttataaaatgtaaatactgatttgactggtctttaagatgtgtttaactgtgaggctatttaacgaatagtgtggatgtgatttgtcatccagtattaagttcttagtcattgatttttgtgtttaaaaaaaaataggaaagagggaaactgcagctttcattacagattccttgattggtaagctctccaaatgatgagttctagtaaactctgatttttgcctctggatagtagatctcgagcgtttatctcgggctttaatttgctaaagctgtgcacatatgtaaaaaaaaaaaaaaaaa

SEQ ID NO: 187784 - DNA, 639 bp, Homo sapiens
  Payload ID: 16961
  Gene Symbol: SVOP
  Gene Name: SV2 related protein
  ENST ID: ENST00000546618
  CDS Start-End: 173-639
ggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatgatactttcatggtggaagatgcagtggaagccattggctttggaaaatttcagtggaagctgtctgttctcactggcttggcttgggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggagg

SEQ ID NO: 187785 - DNA, 695 bp, Homo sapiens
  Payload ID: 16961
  Gene Symbol: SVOP
  Gene Name: SV2 related protein
  ENST ID: ENST00000550436
  CDS Start-End: 156-470
tggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtatgccgagttccttcccatgaaagccagagctaaatgtattttgctgattgaggtattctgggccatcgggacagtgttcgaggtcgtcctggctgtgttcgtgatgcccagcctgggctggcgttggctgctcat

SEQ ID NO: 187786 - DNA, 6813 bp, Homo sapiens
  Payload ID: 16961
  Gene Symbol: SVOP
  Gene Name: SV2 related protein
  Uniprot ID: Q8N4V2
  ENST ID: ENST00000610966
  CDS Start-End: 373-2019
aaagggtgctcactggtacccggacaaccatttcacagactggtgtgccctataggcatcccagtgatacaccatcagccagagagcctgtgaactcttccaagcagaagggctctccctgccccctctccccgcgcagctcgctctgccctccgcctcctcttctccgcccactctcgccgcggtctcctggcggcggaggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatgatactttcatggtggaagatgcagtggaagccattggctttggaaaatttcagtggaagctgtctgttctcactggcttggcttggatggctgatgccatggagatgatgatcctcagcatcctggcaccacagctgcattgcgagtggaggctcccaagctggcaggtggcattgctgacctcggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtatgccgagttccttcccatgaaagccagagctaaatgtattttgctgattgaggtattctgggccatcgggacagtgttcgaggtcgtcctggctgtgttcgtgatgcccagcctgggctggcgttggctgctcatcctctcagctgtcccgctcctcctctttgccgtgctgtgtttctggctgcctgaaagtgcaaggtatgatgtgctgtcagggaaccaggaaaaggcaatcgccaccttaaagaggatagcaactgaaaacggagctcccatgccgctggggaaactcatcatctccagacaggaagaccgaggcaaaatgagggaccttttcacaccccattttagatggacaactttgctgctgtggtttatatggttttccaatgcattctcttactacgggttagttctactcaccacagaactcttccaggcaggagatgtctgcggcatctccagtcggaagaaggctgtagaggcaaaatgcagcctggcctgcgagtacctgagtgaggaggattacatggacttgctgtggaccaccctctctgagtttccaggtgtccttgtgactctgtggattattgaccgcctggggcgcaagaagaccatggccctgtgctttgtcatcttctccttctgcagcctcctgctgtttatctgtgttggaagaaatgtgctcactctgttactcttcattgcaagagcgtttatttctggaggctttcaagcggcatatgtttacacacctgaggtctaccccacggcaacgcgggccctcggcctgggcacctgcagcggcatggcaagagtgggtgctctcatcactccgttcatcgcccaggtgatgctggaatcctctgtgtacctgactctggcagtttacagtggctgctgcctcctggctgccctggcctcctgctttttgcccattgagaccaaaggccgaggactgcaggagtccagccaccgggagtggggccaggagatggtcggccgaggaatgcacggtgcaggtgttaccaggtcgaactctggctctcaggaatagtgaccgatgggggactgagctggtctttgaggctgcagagcttggggggctggcaggccccaactggggcactgattgtcactgccgacatcaagaactcacccaagagtatgacctggaccaacagggttttgtgtcttgactcagtttgctcatcttcattgaggtccacccagggatggggagatgtttgctctagggggttctctgtatatgtggtgaaagctttgttcataacctgtggatctacatgggaagactacccatattaggagggtctggtaatgccagcaaccaatcagacaccacccagagtcacccggccaaaccctcagtgaacaaccaaaatatctctctgtagataccgtccaggctcaggcccatgtgacacctgctgtccacccaccggacctgttcagtaggtttctcccacactcacagccccaggctttcttctttgaaattgcaggcgatctaggtgtggtctgagcagctatttcctggcaggggccccccggtttgcctccctagagcctgaccagtggattctctggcagatggacatggtgcattcaaactggagccacatgcccccacccagccccctctggagttgccgttgttggcaccaagagatccagatgtgtccctggggacagctggtcttgcaccaggtgacaacctcagaacgccgttaccccctgggaactgaggactgaggccaaagtgaatcaagctgaagtcagagcacgggcctccccttctgaagcagcgaaggccacggttccgacttctttcctggccccctccttggtcaggctgaatggtgacttttattgttttttgagacggagtcttgatctgtcgcccaggctggagtgcagtagcgtgatctcggctcactgcaactctgcctcccgggttcaagcaattctcctgtctcagcctcccgagtagctgggattacaggtgcccacctgtactttttagtagagacagggtttcaccatgttggccaggctggtctcgaactcctgacctcaagtgatccacccgcctcggcctcccacagtgctgagattacaggtgggagccactgcacccggcctgaatgatgactcttgaggggaaaaagtttactcaggtttgcaggtacaaaatccaaaatccagggctttgggttttgtgcatgggtagacagctgaatgggcagagaaaccagaaggatgctacacccaccatctcatcccatggggatcaggggaccaggattccctgatgcgaagctgctcctctgtccagggacgtcttgatcattacacaaaggcagcccctggagttccattcatggagcctgccgtggagtggagaggggtgggaggactcaggtgtgtgaaatgtatatgttttcaaaggaagcagtgggaggccagttggttttgagttggtctccgcaggcaacatcacttctgggatttggtttactggagccttttttcccatggtgaaggcaggggacatagacaaggagggaggaagctggcagatcccatcaaaggccagagcagacagacctactgcttgaagtaaacattgcaaggaagccaatttgtgcgttcaactcttattaaaacatgtcagtgatggacattgcaagagcctaagtttattcattgtcatcatgtcctagtgacagtccagcctaacggtctgactacctttgttcatcggaattcatctcaatgctttagtgtgataatctcctttccaatgagtggggaaagacataccgttggcagccaacattgtggctgagcttgttggagacaacactttcttctaatggtgtgcaggtcatgatgggggacttcttccagctcaagttctaaatcaactgcaaacaatactgtgtctctaaaatgtgggctgcagccccctccgcccaggcagttgaagaggagatggcttggcagatctctgtctctctctgacaaccacatttccttgaaccacgtgtggctgtagctctaattatttctggacagctgagctctcctgggtaacacagaacttttgcttgtctcttttgccttccggctggtcagacgctactggatgatcatgtccgctccctcaccctagaataacccagtggagctgggggctgggggggatagagtgcttggtgggcaggaatatttcccagagactagggtaaaggggtttacagttgagggccttctctacttgagaaagtgaaagttaaaaactcctgctgggtatggtggctcatgcctataatcccagcacttttggaggccgaggcgggcggatcacaaggtcaggagatcgagaccatcctggctaacatggtgaaaccccgtctctactaaaaatacaaaaaaaaattagccaggtgtggtggcgggtgcctgtagtcccagctactcaggaggctgaggccggagaatggcgtgaacccaggaggcagagcttgcagtgagccgagatcgcgccactgcactccagcctgggcgacagagcaagactccatctcaaaaacaaaacaaaacaaaacaaaaactctttgccttgtaaatagcctgcctttttcaaaaaaatcaatattatcaaatgatacaagagctatcacaaaaggcacccaaacttctgaatatgtgagacctttagctgagaacatttgtatctaattttgaacaatcctattcaaaaagctcctattttcgttaatggaaatgccatgtttctcttagagttacgaaagatctcagaaagtggcaaaagatatttaatgtagccagagctatatatttctgtttttctcgtacttcaagtattctgaaaaacatataactgaccttggtggtgttcacaatgggatgaaacagtatcttaggaattgactttgaaattagtatggaaattcattgtttttaatataacattgagcaacagaaagccttgaatgataagatcaagagtctcccctgccattattttcaatggcaaaaactgcaattactttttttttttttttgagatgaagtctcagctcactgcaactctgtctcccaggttcaagcgattctccctcctcagcctcctgagtagctgggattacaggtgcccgccttgatgcttggctaatttttgtatttttagtatagacaaggtttcaccatgttggtcaggctggtctcaaactcctgacctcaagtgatccgcccaccttggcctcccaaatgcaattacttttgcaccaacctaagaacagtaatctcagtcaatagtggcttaaaccattagaaccaaaaccaggcagagatcagagaaggttcaacgctcaacaatgttatcaagaacccagcttctttttgccttttcttttcaccatcctctgcatgttggccatctgaccctgtgcttgaaacctcatggtcacaaaatggctgcccctgtgctggacatcatatttcttttcaaagaaggtagaatgggaaaggagcagtcataaaaggttttctttcagaagagtctgttggttttggttagaaaaggaagtcccctggcagatttaccattgcttctcattgatcagacctgggtgtcatgcccatcccagcatgagtcctgctgtagggctggaaggaagggcctacgagcaccaagggatacccacagcctcctgaacacaaaattgggattctgttagcacagaagaaggatagcaatggctgttggatgggcgatggttgcaaggagcctgccgtggatgtgtaggccacagagctctcatcagcactgttttcgtggccaggaacagaaattctactcaggataattaaaattaaggaacagagctttattataagactgggatcggtagttaatttcctacaggggaaattcagggcatgtaaatcagtgaaatggaaaaggtgtaaggacaagagaaacaccagccctgtctgcaggggggggctgcaactcccttccagctgatgttgttccaccatgggtccagtgtgaccagatcttacaatgttcaaaagaggagtctaggtttttctgtgaaatctccaaatattagtatattggatcaaaaatgttcaaatgatgtgtgagctcaataaaatgcatctgcagtgcagctttggttgatgggctgatggttcactctgacagtttagagagattgcataggaataaagtacagcctggtgtcattcagaggaacagggatctgggaaaccactggggcccaagacagctgcccctctgaatctgtggctcttgtttcttcccttttctggcagaaatgagtctagcttccatctgtttccttgtggctgctgtgtatgcataatcatgcacagagcttccatagcctcataacccagctctgcaaacatacctgactcagctgctcagtgccccactcccagatcttcaggaatgaagctgattggcccagtttagtgttggattgagtcttggtccaattcaattgggtcaggaagaagtggtggagaggtacagacacggtggcattggcctgccctttagcagggtggtgcagacaattgctggtatgcctggaatctgcagtgacatgtgcataaactctcaagtctattcatcagaactctcttacagatcataacgtggcaagtggtcagtatgcatggaatatccagcatgtcctggacatgttattcaacactgaggatgcaaaatatcataagacatggtcctggctgggtgcagtggctc

SEQ ID NO: 187787 - DNA, 1413 bp, Homo sapiens
  Payload ID: 16962
  Gene Symbol: SVOPL
  Gene Name: SVOP-like
  Uniprot ID: Q8N434
  ENST ID: ENST00000288513
  CDS Start-End: 66-1088
cttgcagatggtgttttttggctacatggttttcagtatcctctttggcctcctggctgacagatatggccgctggaaggttaatcataaagactgaatttttgcccacgaaataccgaggctatatgttacccttgtctcaggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgattttttttttaaaggcatatatgggaatggggtaggtaactgtatattgatctcttccttgaggaacaatatataaagtacttttataaaatataatttaagctttcaaaggggtgtgagagggagatggtgggggggaagatggcttttcttcattgaaatcaagtctgtaaacctttatatgaataaatactaaattttaaactta

SEQ ID NO: 187788 - DNA, 5761 bp, Homo sapiens
  Payload ID: 16962
  Gene Symbol: SVOPL
  Gene Name: SVOP-like
  ENST ID: ENST00000441685
  CDS Start-End: 3980-4681
ttggatttggtgtttaaagttatgtctatttgtaataacataaagggagactgcttctagtggccccaatttgtgtactgtataaggcagcgcatgaacagacaattttaaaaattacagtggaaattcacaagtacacatctgaatagagtggagccgaagccgtcctctagcaacaagcgggcggcagaggaccccgtttccacctggggcaggatctgccttgttaggctcccaccaacagggagctgaaatcctgaacatgaagggcctcaggggcaagcaagaccaacgtgaaaccctgttctttaaattaacttccatccctcccgtatttccagcctacttctagtgaaaatggctaacggggtaaagtaacatgtaaaacctgcttagagaaccgttttatctcgctcccacttgcagatggtgttttttggctacatggttttcagtatcctctttggcctcctggctgacagatatggccgctggaaggtaggtggggcctcacagtagcatttggaattgtcttttgtgtattcttttgggggcaaccttatcactgtttctctttagtaggcatctccctcccaatacccaagatagaaaatgcagacatttccctccctgatggaacattccaggcttatcttctggacatttttctcagggtacctgtgcctgcagctgttcctctgcagtccaggtgtggagtaaaaggagatgcgggtattatagagttctaagaaatctctacccagaaggattaaaggaaggaaggccgctaagtggctctatttgaacttttaaaggttgggacttagaagcagtcatgggttggttagatgcccccaccacgtccagtttactgtggtggtgttgagaacagaggtctgatatcagtgggggcacacatctgttctccatttatccatatcttcgcttctaatgagttaataaggggaatggaaaaggccccttagcccttcagagcagccctattgggaggttttttcctctggttttcatttaaatgactagtccactgctgcaacagcaagctcagaagaagctgttctttcaggactatgtgtcatgagtgagtgtccataaagtctctaaccccccagagcacccaagtaggttgggagggagcaagtctcccttaattttggggcaagaaaactcaccctcaggcacctatctgtttgaaactagcaggaactggccacaaatgaaaagagaagtccaaattacaatcagtaggaaacagatgcaagttttaaagcctgtgatggaattttaggacaagaaaaagtaaaatgactagtgctggatggccaagaccattaagccaaacctgctgctatgaggcagaggcagagaaagcagaagttctctgcagagccatttgcctgaatgtcccgtccagggacagaaatggaagcccatgctcttaaatgagagagtttataaagaagccacccaaactgtagacctcaacctaaaggaaaggagggccagattcagaaagactcacccttttgcccccagtgaaacctctggagttaggggaacgcagtgggttcatgcagcaagttcaagaggagcctattggtaattgtgggggtaaggggtggtgttgctctgaaccttgccagctatgccagaaatattgacctaaaggaagaaacagagacgaaattaatataagtagggagtttatttggaccaagattgaggattgcagctcggaagtcatacagtccagttgccctgaatatatgctccgattagcagcagttacaagtgggttttttaaaggaggagagaaaagaatttgggggcacttcctaagttatttactaataatttacattggttcgttaaaataaggtatgctatcagctgattctacatctttcttggtgtcacaaaatctaaaaacatggagataatggatgagcgtcacattgtgcaacttgcggtaaccttttaggtaatttatcagctagtctggaaactacagggaaggtaagaaaaacaaaatgaaatacaattaccctgggcatgggtgcgggaatgtgaccggagtcgcatgctcctgtgtctctggacctgataaattctgcatacctcacattcctcagactgttctgagccgcttttctctctcaagttgatggatgtacggagttaaaacatattagagtgtggacatttgcaggtataaacataagcagctacacattttgctcatgttggtatagctttgaaactagctacgtgctcaaagtcacgtgcctactaagattagacatcaagacataaattatgtcttctgattacaaacccaggtctgtcttttctatttgcttgatttctggtgaaatcctctctgagcataaacacaaatggaggaatctcaaaggaaaacattagtagaattggctgtatgttttaaagtacatgaaataaatagcatagattcttgtaaatttgaaaacacgagtatctcaaaaaagcacaaaaaggcattttataaaagaaatacaaattatcaagaaactttgaaaaaacattaaagtacaggagttatcaaaaacaaaatacatagcaagatataatttttccttatcaaatatgtaaggaaatttttccttaaagagtcctgcaccgttgaaatggacattttcatgacttgcaagtatatagacacccttactatatataacaccctgttggtgttaatatatcattattattatataatattattaaaccctattggtataatttttctgaccatcagcctggcagtatgaaacatgaaccttgaaaatattctgctaacctgaacatttgtcttccagaaatctagcttgctaaagatatcagagagggcataacgacttatgtacagatatcatcgcagcttattttaataatgagaagatctgaaacaacttaaactgcaacagtagagcaaggtcttatgtattatattacatgtatgaaagtacatctttccactggaacatttatagccagccattaacacttcgttttctctcataaacagagaagataaaacagtgttaagagttatcttctctgggttggacaatcaatggtgatttcaatttcttaattttcttttttcttctgtattgtttactatgaatttatccttataattaaagaaaaagcaaataccttaaatgttctccttgtactcctcccaacatactgcctcattacgtccccagcagccctgtgagtagggaggacacgtttttgccttttgatgtccaagttcagggacctgccacccatgagggtgggcacagcatggtagttttaaagaatggtctgaacttggtaggtctgggcttccagacagtagaatggcatggattgtattgttggatgattgtgaaagaccagtgggcttgctacaggttagctcctcagagaagcaactatcaggatggaaaccgaaaatcgccttcagaagttagggcttcttccctccccgcattgaggcaggtcccattcatgtgttctgctgttgcttcagattctgctcatctcgttcctgtggggagcctatttctccttgctgacctcgtttgctccttcgtacatctggtttgtcttcctgcggacgatggtgggctgtggtgtgtccggccactcgcaagggttaatcataaagactgaatttttgcccacgaaataccgaggctatatgttacccttgtctcaggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccagagagctttgctgttggttaaccacttcatactttactgtcgttgtgagattaatggagaactatcaagaacacagaccaagagaaactaaagtatgagatggagtatctgaattaccagtatctgcgtgaaaagatccaggccaaagcatgtgtacagatggacagaaacccagttactgtggaaaaattgacaccaaagagttttggtgtcacacaactccataaccggagacaagacacattagcaatcctttcagagactctgagataacacctcttccaaaaaaaactttcacctgtttcatgctgtcaggactgaagagataatggatatttggcagacagaggatatagcatgaagtgagagttagaagttaagcaagctgaaatggtatgagaaagggggtggggaaacgggcagatcccccatcttttccatatatcaaaacttggctctggagatgcctgacaggtggatgccaagagaggtcttacctggccaatgcgtgttaataccagttcctgttcttggactaatcacacaaaatgactacaccagattggctcagataaatcaatttgtcaggaaggtacaacctgtagaatggctgcaaaggaccatcttagtgaagtgaatctgtattttctctttcacataaagaacagtttagaggtaactggagcataataaattgagtaattctcttgtgacttgcaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgattttttttttaaaggcatatatgggaatggggtaggtaactgtatattgatctcttccttgaggaacaatatataaagtacttttataaaatataatttaagctttcaaaggggtgtgagagggagatggtgggggggaagatggcttttcttcattgaaatcaagtctgtaaacctttatatgaataaatactaaattttaaactta

SEQ ID NO: 187789 - DNA, 1523 bp, Homo sapiens
  Payload ID: 16962
  Gene Symbol: SVOPL
  Gene Name: SVOP-like
  Uniprot ID: Q8N434
  ENST ID: ENST00000419765
  CDS Start-End: 35-1513
ggaagctgtttggggaacttgagctatttagaagatggcaaccaagccaacagagcctgtcacgatcctcagccttcggaaattgagcctggggaccgcagagccacaggttaaagagccaaagacgttcaccgtggaagatgcagtggagactatcggcttcgggcgtttccacattgccctctttctgatcatgggcagtactggggtggttgaggccatggagatcatgttgatagctgttgtgtctcctgtcatccgctgtgaatggcaactggagaattggcaggtggcattagtaaccacgatggtgttttttggctacatggttttcagtatcctctttggcctcctggctgacagatatggccgctggaagattctgctcatctcgttcctgtggggagcctatttctccttgctgacctcgtttgctccttcgtacatctggtttgtcttcctgcggacgatggtgggctgtggtgtgtccggccactcgcaagggttaatcataaagactgaatttttgcccacgaaataccgaggctatatgttacccttgtctcaggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaa

SEQ ID NO: 187790 - DNA, 1653 bp, Homo sapiens
  Payload ID: 16962
  Gene Symbol: SVOPL
  Gene Name: SVOP-like
  ENST ID: ENST00000421622
  CDS Start-End: 210-1328
gatctgagacccgacctgaaaggagaggataagaccagggagccaggcgtcttgggaacacaagtctggccacccctgagaagccatctgtgctccaatttccgtctaagacttggccacggtgaggggagcaaaagagcctgaaattggaagactgtccaaggaatatacagagggaagctgtttggggaacttgagctatttagaagatggcaaccaagccaacagagcctgtcacgatcctcagccttcggaaattgagcctggggaccgcagagccacaggttaaagagccaaagacgttcaccgtggaagatgcagtggagactatcggcttcgggcgtttccacattgccctctttctgatcatgggcagtactggggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgattttttttttaaaggcatatatgggaatggggtaggtaactgtatattgatctcttccttgaggaacaatatataaagtacttttataaaatataatttaagctttcaaaggggtgtgagagggagatggtgggggggaagatggcttttcttcattgaaatcaagtctgtaaacctttatatgaataaatactaaattttaaactta

SEQ ID NO: 187791 - DNA, 1420 bp, Homo sapiens
  Payload ID: 16962
  Gene Symbol: SVOPL
  Gene Name: SVOP-like
  Uniprot ID: Q8N434
  ENST ID: ENST00000436657
  CDS Start-End: 74-1096
caggacgtcttccagatggtgttttttggctacatggttttcagtatcctctttggcctcctggctgacagatatggccgctggaaggttaatcataaagactgaatttttgcccacgaaataccgaggctatatgttacccttgtctcaggtgttctggcttgcgggctccctgctcatcattggcttggcctctgtgatcatccccaccatcgggtggcgctggctcattcgcgtcgcctccatcccgggcatcatcctcatcgtggccttcaagtttattcctgaatctgcccggttcaatgtctccactgggaacactcgggctgccctggccactctggagcgcgttgccaagatgaaccgctcggtcatgccggaggggaagctggtggagcccgtcctggaaaaaagaggaagatttgcagacctattggatgctaaatatttacggaccacattacagatctgggtcatatggcttggaatctcttttgcctactatggggttatcctggccagtgctgagctgctggagcgggacttggtctgtggttcaaagtcagactctgcggtggtggtgactgggggggactcaggggagagccagagcccctgctactgccacatgtttgcaccctctgactatcggaccatgatcatcagcaccatcggtgaaattgctttgaatcctttaaatatactgggcatcaatttcctgggaagacggctgagcctttctattaccatgggatgcacggctttattcttccttctcctcaacatttgcacttcaagtgccggcctgattggcttcctcttcatgctgagggctctggtagctgcaaacttcaacaccgtctacatttacacagctgaggtctaccccaccacgatgcgcgctttggggatgggaaccagcggctccctgtgtcgcattggtgcaatggtggcaccatttatatcccaggttcttatgagtgcatcaatactgggggccctgtgtctcttctcatctgtctgtgttgtatgcgccatttctgcattcactctccccatcgaaaccaaaggacgggccctccagcaaattaaatgaagacctgcaaagctatgtctaccagatgagaaaaatgaattctatcttcagaactgcggtgcatttttttaaaacttggttttacttctgtatgctactcggtaattagtaaagtgattttttttttaaaggcatatatgggaatggggtaggtaactgtatattgatctcttccttgaggaacaatatataaagtacttttataaaatataatttaagctttcaaaggggtgtgagagggagatggtgggggggaagatggcttttcttcattgaaatcaagtctgtaaacctttatatgaataaatactaaattttaaactt

SEQ ID NO: 187792 - DNA, 4882 bp, Homo sapiens
  Payload ID: 16963
  Gene Symbol: SWAP70
  Gene Name: SWAP switching B-cell complex 70kDa subunit
  Uniprot ID: Q9UH65
  ENST ID: ENST00000318950
  CDS Start-End: 104-1861
aggtgactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaaggtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggagcagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagagcagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtttcttatagttgcctttataaagtgtattgtctaaaatatttttgtatcatgtgcctttgaaatttgacagctgatttgggtgttggatttctgcccagccatttatcagtattatcattttattcagtagctggcaggtgtattagaccaacgagacttaggtaaggaatggaacctttcctgtggtttgactgcacattacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggta

SEQ ID NO: 187793 - DNA, 3538 bp, Homo sapiens
  Payload ID: 16963
  Gene Symbol: SWAP70
  Gene Name: SWAP switching B-cell complex 70kDa subunit
  ENST ID: ENST00000447399
  CDS Start-End: 104-1687
aggtgactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcaggccaggttgttggaggaagagtcttccaagagggctgaactagaaaagtggcacttggagcagcagcaggccattcagacaaccgaggcggagaagcaggagttggagaatcagcgtgtcctgaaggaacaggccctgcaggaggccatggagcagctggagcagcttgagttagaacggaagcaagcacttgagcagtacgaggaagttaaaaagaagctggagatggcaactaataagaccaagagctggaaggacaaagtggcccatcatgaaggattaattcgactgatagaaccaggttcaaagaaccctcacctgatcactaactggggacctgcagctttcactgaggcagaacttgaagagagagagaagaactggaaagagaaaaagaccacggagtgactgagcttgctggcagtcacgtcagttatgtagatactgcatggcaggagagctttacgctaaagacaaaagaaacagctttgggggccgggcgtggtggctcacgcctgtaatcccagcactttgggaggccgaggcgggtggatcacctgaggtcaggagttcaagagcagcctggccaacctggtgaaaccctgtctctactaaaaatacaaaaaaaattagctgagcgtggtggcgggcgcctgtaatcccagctacttgggaggctgaggcaggagaatcacttgaacgtgggaggcggaggttgcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaagtcaacattgtcaagctgtttgtttactctttctttgaaaacatcaccttctgaaatttgtcttttagctctctcagattcttccccaaatgaggcagggtgcagacagcacagtcagctctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattcagtgtatgtatttatttacatgagaggaaactggaatataatcccataaattatcaccttttatgactggaaaatatttgccaatgaagaaatggtctgtaggtatttgtcttaagatttttggctgtttaataaaaatgtaactttaacggtt

SEQ ID NO: 187794 - DNA, 813 bp, Homo sapiens
  Payload ID: 16963
  Gene Symbol: SWAP70
  Gene Name: SWAP switching B-cell complex 70kDa subunit
  ENST ID: ENST00000526358
  CDS Start-End: 100-549
gactgcgcggcgggctgtggctgcggaggttgaggggcgtccgaggcgcggaggggctggctgggcaggaggggttggcggggcagcagggccgcggccatggggagcttgaaggaggagctgctcaaagccatctggcacgccttcaccgcactcgaccaggaccacagcggcaaggtctccaagtcccagctcaaggtcctttcccataacctgtgcacggtgctgaaggttcctcatgacccagttgcccttgaagagcacttcagggatgatgatgagggtccagtgtccaaccagggctacatgccttatttaaacaggttcattttggaaaagattaccaagacccttcctgcctcagagccttcagacatgctgcttcctgtgctgtccaagacaactttgacaagattgaattcaataggatgtgttggaccctctgtgtcaaaaaaaacctcacaaagaatcccctgctcattacagaagaagatgcatttaaaatatgggttattttcaactttttatctgaggacaagtatccattaattattgtgtcagaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagg

SEQ ID NO: 187795 - DNA, 977 bp, Homo sapiens
  Payload ID: 16963
  Gene Symbol: SWAP70
  Gene Name: SWAP switching B-cell complex 70kDa subunit
  ENST ID: ENST00000534562
  CDS Start-End: 1-71
attttcctgttggtctggggcagagttcctccttcagaatattgagaggtcaggcagaaagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacgccttcagactcaagtggaacttcaggccaggttcagcacagagctggaaagagagaagcttatcagacagcagatggaagaacaggttgctcaaaagtcctctgaactggaacagtatttacagcgagtacgggagctggaagacatgtacctaaagctgcaggaggctcttgaagatgagagacaggcccggcaagatgaagagacagtgcggaagcttcagcgagctgagatcatgccgttgtactccagcttgggcaacagagtgagactccatctcaaaacaaaacaaaacaaaacaaaacaaaaaaacccggctttgctgcttttaactcttcttccttctgtgcctctctaagtgggtcagtatcctaaggaagccttcttatttatcttcctgcaaacaagggttacctgaaaagaaaaaaaaa

SEQ ID NO: 187796 - DNA, 1131 bp, Homo sapiens
  Payload ID: 16963
  Gene Symbol: SWAP70
  Gene Name: SWAP switching B-cell complex 70kDa subunit
  ENST ID: ENST00000534662
  CDS Start-End: 452-1131
agaattgatgcaggccactagagactaaaacggcaacacatgatttattatttagtataattgaatagtggagaatggtaatgtttgtctctccttggcccaatataatgaatcaaaaggcccttaagttatttggttatgatacgtatatgattgtgttgaaagtcagcaggaaatgaatctagattagttgtctggcacagtcactgggaatgctgagcagatcgaagctgggtgctaatgacaacttcataaggcttgggagggcaccttcagaaaggttcaggatgaacctggcaagctacttctagagctgagtttgctactaataggcgctttctgagttacaaacataacaagtcatctgattttgaagaaactgaagcttggagtgtgaatgacgtgggttcagtaagagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagagtccttgcctgacaaagatggaaagaaatgcctttttctcgtaaaatgttttgataagacttttgaaatcagtgcttcagataagaagaagaaacaggagtggattcaagccattcattctactattcatctgttgaagctgggcagccctccaccacacaaagaagcccgccagcgtcggaaagaactccggaagaagcagctggctgaacaagaggaactggagcgacaaatgaaggaactccaggccgccaacgaaagcaagcagcaggagctggaggccgtgcggaagaaactggaggaagcagcatctcgtgcagcagaagaggaaaagaaacg

SEQ ID NO: 187797 - DNA, 3564 bp, Homo sapiens
  Payload ID: 16964
  Gene Symbol: SMARCA1
  Gene Name: SWI/SNF related, matrix associated, actin dependent regulator of chromatin, subfamily a, member 1
  ENST ID: ENST00000371121
  CDS Start-End: 36-3248
tgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatgtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagaga

SEQ ID NO: 187798 - DNA, 4099 bp, Homo sapiens
  Payload ID: 16964
  Gene Symbol: SMARCA1
  Gene Name: SWI/SNF related, matrix associated, actin dependent regulator of chromatin, subfamily a, member 1
  Uniprot ID: P28370
  ENST ID: ENST00000371122
  CDS Start-End: 131-3295
gagcgaaggggttggaagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaat

SEQ ID NO: 187799 - DNA, 3948 bp, Homo sapiens
  Payload ID: 16964
  Gene Symbol: SMARCA1
  Gene Name: SWI/SNF related, matrix associated, actin dependent regulator of chromatin, subfamily a, member 1
  ENST ID: ENST00000371123
  CDS Start-End: 116-3292
aagcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatgtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaa

SEQ ID NO: 187800 - DNA, 5761 bp, Homo sapiens
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENST ID: ENST00000349721
  CDS Start-End: 154-4926
gggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 187801 - DNA, 2242 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000302401
  CDS Start-End: 521-1357
acttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggtttggaagggaattctttttgggggtagtactttagcattgtgtagcaagttttggggttttttttgtgtgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaa

SEQ ID NO: 187802 - DNA, 1781 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000324954
  CDS Start-End: 200-946
ggagaggcggaggtggaaacgatgcgcaggagttggcttggggctttttgtttgcgtgtccctgtttacctattcataatcatggatcccctctgctttgtgatactgtgaaccacgcataacagcaattctttacaccaccgggttgagaagaaggcgcctgaggctgactttctggacctgccgtcacgcagtaaagatgtggttggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 187803 - DNA, 5712 bp, Homo sapiens
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENST ID: ENST00000357248
  CDS Start-End: 113-4831
ctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttga

SEQ ID NO: 187804 - DNA, 1178 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000382183
  CDS Start-End: 165-875
ttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttgg

SEQ ID NO: 187805 - DNA, 1584 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000382185
  CDS Start-End: 106-936
attcacttcattaaatctagaggcagttgagcatgggagccgtctgtatgttgaattagggctcgcactcttgcgcaacacgtcaccagtcggaaactggggctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttg

SEQ ID NO: 187806 - DNA, 955 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000382186
  CDS Start-End: 178-942
ggcagttgagcatgggagccgtctgtatgttgaattagggctcgcactcttgcgcaacacgtcaccagtcggaaactgggggtttgcttctgtgatttatttcattattgtgctgtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacct

SEQ ID NO: 187807 - DNA, 5679 bp, Homo sapiens
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENST ID: ENST00000382194
  CDS Start-End: 123-4841
gtgcgcgcaggagccagtgcgtcgggagcagcggctcgggcagctgctcctgcccgcaccctcccctggagcccggggaggacaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaa

SEQ ID NO: 187808 - DNA, 5867 bp, Homo sapiens
  Payload ID: 16965
  Gene Symbol: SMARCA2
  Gene Name: SWI/SNF related, matrix associated, actin dependent regulator of chromatin, subfamily a, member 2
  Uniprot ID: P51531
  ENST ID: ENST00000382203
  CDS Start-End: 210-4982
tcagaagaaagccccgagatcacagagacccggcgagatcacagagacccggcctgaaggaacgtggaaagaccaatgtacctgttttgaccggttgcctggagcaagaagttccagttggggagaattttcagaagataaagtcggagattgtggaaagacttgacttgcagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaa

SEQ ID NO: 187809 - DNA, 980 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000417599
  CDS Start-End: 131-961
attaaatctagaggcagttgagcatgggagccgtctgtatgttgaattagggctcgcactcttgcgcaacacgtcaccagtcggaaactgggggtttgcttctgtgatttatttcattattgtgctgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttcc

SEQ ID NO: 187810 - DNA, 5602 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000450198
  CDS Start-End: 223-4767
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaa

SEQ ID NO: 187811 - DNA, 750 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000452193
  CDS Start-End: 203-750
cttggagaggcggaggtggaaacgatgcgcaggagttggcttggggctttttgtttgcgtgtccctgtttacctattcataatcatggatcccctctgctttgtgatactgtgaaccacgcataacagcaattctttacaccaccgggttgagaagaaggcgcctgaggctgactttctggacctgccgtcacgcagtaaagatgtggttggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgc

SEQ ID NO: 187812 - DNA, 755 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000439732
  CDS Start-End: 110-755
gcgtcgggagcagcggctcgggcagctgctcctgcccgcaccctcccctggagcccggggaggacaaggcgagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgc

SEQ ID NO: 187813 - DNA, 633 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000416751
  CDS Start-End: 56-633
agtagaactacatcccaggcatgtgtaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaa

SEQ ID NO: 187814 - DNA, 834 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000423555
  CDS Start-End: 150-834
cctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaata

SEQ ID NO: 187815 - DNA, 736 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000457226
  CDS Start-End: 158-736
tttccggtacacgcggggaaatcgcctcctgccagtgtctgatcgctcgcctccgcctccgcctctgccgcctggattgcattattatttttatccgggttgccgtttgctgcggatggtgcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcc

SEQ ID NO: 187816 - DNA, 683 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635185
  CDS Start-End: 1-683
caaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaaggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagct

SEQ ID NO: 187817 - DNA, 1118 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634989
  CDS Start-End: 136-432
acttcattaaatctagaggcagttgagcatgggagccgtctgtatgttgaattagggctcgcactcttgcgcaacacgtcaccagtcggaaactgggggtttgcttctgtgatttatttcattattgtgctgctgatgaagagactagcagctcgctgctttgctggcttgttaattttatccccactaactgtgatttctgatagccggcctgctgatagtggtaagtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctat

SEQ ID NO: 187818 - DNA, 424 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634287
  CDS Start-End: 239-424
gtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggcc

SEQ ID NO: 187819 - DNA, 758 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635133
  CDS Start-End: 158-758
aggctgaaatatgcttaactgttttaacttgactggggatttttaccaccatatgggttttttttcgtgacatccggagccaaacgggtgcagtgtgcctttaagaaaagaggtgcctcactaaacttcgctgtagttgtgtttcaccgtctcgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatg

SEQ ID NO: 187820 - DNA, 712 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635530
  CDS Start-End: 26-712
cagttgagcatgggagccgtctctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaa

SEQ ID NO: 187821 - DNA, 744 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634435
  CDS Start-End: 10-744
gtgctgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctc

SEQ ID NO: 187822 - DNA, 5847 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634760
  CDS Start-End: 349-4635
ggaggacaaggcgaggtttggtggcgagggctggtgggggtggcgtgtgcgtgtggttgtgagtgtgtgtgtgtgcgcgcgcgagcggcggagaatcaggaagtcacagcagcgaagcgcacacagcacacagacatgtttgattgccgtgacatgacgcgcgcgagggaggaagcggcagcggcgggggccgggccgcgggctgtggcgcgggcctagagccgcggctcggagaccggttcccgtccgccggccgcgccgccaccccaagctccgcgaaccccgcgcccctttttgttccgcgtcctccagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttc

SEQ ID NO: 187823 - DNA, 711 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635388
  CDS Start-End: 106-711
agttgagcatgggagccgtctgtatgttgaattagggctcgcactcttgcgcaacacgtcaccagtcggaaactgggggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaa

SEQ ID NO: 187824 - DNA, 1106 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634781
  CDS Start-End: 312-1094
tccttcatagtggttatctgaacactgtaggatcgtgatggaaattgtcttttgattattaaggcctaggctcagactgtcccttaggaatctgtctgtgtgcatgttgcttctatggatttgcacattggaggatgcgtagaaaacatatttttttaaaaatcccactggcatttttaacatgccaggttgttttgtgttctgcaccaggttttcttcacaaaacctttctttttcaggaagcgttgtacataagtgaaagaaattatgtctgagctgtaatcactctttatattgattgttatactcacatgatcataaatattagccatgtttggtgctgtggagaaatgaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacc

SEQ ID NO: 187825 - DNA, 762 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635659
  CDS Start-End: 1-176
agcctttccccagctctcttttttttcctgatcagctgatgaagagactagcagctcgctgctttgctggcttgttaattttatccccactaactgtgatttctgatagccggcctgctgatagtggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaagg

SEQ ID NO: 187826 - DNA, 740 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634338
  CDS Start-End: 8-740
gtctctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagc

SEQ ID NO: 187827 - DNA, 939 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634931
  CDS Start-End: 76-840
tcgtgacatccggagccaaacgggtgcagtgtgcctttaagaaaagaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttc

SEQ ID NO: 187828 - DNA, 897 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634688
  CDS Start-End: 451-897
aatgaaggtaattgccttatgattagagctctttcagctacgagaaaggattgattatcatttgcatactggaggcaatattgagaggcaggaggaacaaataacaacattagttattttgtgtgagagagcaatctcaaaacgtaatttaaagatcttttttttagaaaatttcttttctatgttcaaattttatgttctttttttttttcttccttggcagtatttttcccctttatttttcttcttttgagttttgagatttaccaggaaaaaaaaaaaaagtttaaacttctgggtctgtcacatggatcttttagccctttatgaacaggtttcttttatacctggttgtttttatagctattttattatctctctgcattagtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccgg

SEQ ID NO: 187829 - DNA, 291 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635392
  CDS Start-End: 1-115
ttcagggcgacagctcagtgaagtcttcattcagttaccttcaaggaaagaattaccagaatactatgaattaattaggaagccagtggatttcaaaaaaataaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagca

SEQ ID NO: 187830 - DNA, 630 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634706
  CDS Start-End: 123-630
gtctgtatgttgaattagggctcgcactcttgcgcaacacgtcaccagtcggaaactgggggtttgcttctgtgatttatttcattattgtgctggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaag

SEQ ID NO: 187831 - DNA, 810 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634772
  CDS Start-End: 1-810
cttaaatcttcaggcagctgatacagtggtcatctttgacagcgactggaatcctcatcaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttaca

SEQ ID NO: 187832 - DNA, 616 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635688
  CDS Start-End: 413-616
gtgatttatttcattattgtgctggtaaaaggtttggaagggaattctttttgggggtagtactttagcattgtgtagcaagttttggggttttttttgtgtgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtg

SEQ ID NO: 187833 - DNA, 640 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635226
  CDS Start-End: 1-174
gcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacaggtaacgcaccccgccagcaaggggccccctgcggtgtgctagcacctgccgcccaagccgaggggggtgaggcgcctgcctccttggttggccaaactgtgattttcacccgtgcggtcggaaaactttcatccactcctggggccttcccggtgctgaggggaggcaccggggttttgaagatcaaaagccgacggggacttcctgtggacccgagagagtgatcatctcacactgcgactgtggaatacactgtccgtgtttgtgcttgtgcggttcggtgatgacggaggggctgggacgctgagtgtgttgcgctggcctgattttcatgttaactgtacgtttctactaaagcatccttcggtagcttggtataatctttgttttaattcacgtgtgtctatgcagtgatccagccttatgggtataccctgtgcgagtgtctttatacaaggtctatacttaaa

SEQ ID NO: 187834 - DNA, 1843 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000635590
  CDS Start-End: 146-442
ttcacttcattaaatctagaggcagttgagcatgggagccgtctgtatgttgaattagggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccggcctgctgatagtggtaagtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttc

SEQ ID NO: 187835 - DNA, 792 bp, Homo sapiens
  Payload ID: 16965
  Gene Symbol: SMARCA2
  Gene Name: SWI/SNF related, matrix associated, actin dependent regulator of chromatin, subfamily a, member 2
  ENST ID: ENST00000634343
  CDS Start-End: 98-792
agccttcgggccttgtagtaggtagcatgaaacagcagatttgagtatccacaatcctttcagtattaaattttcagtaaaataaaattacttgtatatgaaaacacagcctttccccagctctcttttttttcctgatcagctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtc

SEQ ID NO: 187836 - DNA, 5392 bp, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENST ID: ENST00000344626
  CDS Start-End: 206-5149
gtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaa

SEQ ID NO: 187837 - DNA, 4938 bp, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENST ID: ENST00000444061
  CDS Start-End: 97-4938
tgcccccggccccgcgcggaggggcgggggaggcgccgggaagtcgacggcgccggcggctcctgcttgaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 187838 - DNA, 5691 bp, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENST ID: ENST00000429416
  CDS Start-End: 282-5225
gtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagcc

SEQ ID NO: 187839 - DNA, 5506 bp, Homo sapiens
  Payload ID: 16966
  Gene Symbol: SMARCA4
  Gene Name: SWI/SNF related, matrix associated, actin dependent regulator of chromatin, subfamily a, member 4
  ENST ID: ENST00000450717
  CDS Start-End: 1-5040
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagcc

SEQ ID NO: 187840 - DNA, 5512 bp, Homo sapiens
  Payload ID: 16966
  Gene Symbol: SMARCA4
  Gene Name: SWI/SNF related, matrix associated, actin dependent regulator of chromatin, subfamily a, member 4
  ENST ID: ENST00000413806
  CDS Start-End: 1-5046
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatgggacagagggaaaagagcaggcgcgggcttgggagtcagtcctgggctcggatatttgctgatctctctgatcatcagaatgactgtgtgacctcagtgactgagtcgctggttgggcagatattggcagcgtgttctggtgaggagggggaagtggagtggaaggggagggacagggtaagaaggcttcgggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagcc

SEQ ID NO: 187841 - DNA, 5139 bp, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENST ID: ENST00000541122
  CDS Start-End: 286-5139
tttcgtgaagagaagcgagacgcccattctgcccccggccccgcgcggaggggcgggggaggcgccgggaagtcgacggcgccggcggctcctgggaaaggagcctctgcttcacattttgatgggagcatctgaggacctcatctgtgtgatgctcctagtgcgatacctttcacgtgctaagcagctgctcagtaaacctggggagagatggggcaccttggtttcaccagctgagcggctggcacttcctgcctgaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 187842 - DNA, 5181 bp, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENST ID: ENST00000589677
  CDS Start-End: 331-5181
cattctgcccccggccccgcgcggaggggcgggggaggcgccgggaagtcgacggcgccggcggctcctggcaggagtgcagtggtgcgatccgggctcaccgcgatctccgtctcccaagttcaagcgattctcctgcctcagcctccggagtagctgggaccacaggcgtgtgccaccatgtccagctgattttcgtatttttagtagagatggggttcgccttgttggccagactggtctcgaactcctgacctcaaatgatctgcccgcattggcctcccaaagttctgggattacaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 187843 - DNA, 5282 bp, Homo sapiens
  Payload ID: 16966
  Gene Symbol: SMARCA4
  Gene Name: SWI/SNF related, matrix associated, actin dependent regulator of chromatin, subfamily a, member 4
  Uniprot ID: P51532
  ENST ID: ENST00000590574
  CDS Start-End: 438-5282
ccggcagccgcgcgcgtggggaaggccacagtgtcgcgaggccgtggcagcggcggcccccgcggagcggcggggtgggtggggggcccgggccgcgtggaggccgcgcgatcctctccgcgcgcgctctcgccggggtcgccggacaaagctcgcccccctcgcccggcacccctacagtcgccctcccaattacagcggctgcaacaataggcaggcgttggggcttttctggctgcgtggtaacgggtccgacccgaatgttgcgtttttggcgaagctgcgatcggggctcagccaaacctccagatatgtccggcgtcggccggacacgggcattagcggtccccttgggctagccgacctcaaattgtcttaaaaacgtgtcattccagattttcaaggaaaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactga

SEQ ID NO: 187844 - DNA, 409 bp, Homo sapiens
  Payload ID: 16966
  Gene Symbol: SMARCA4
  Gene Name: SWI/SNF related, matrix associated, actin dependent regulator of chromatin, subfamily a, member 4
  ENST ID: ENST00000592158
  CDS Start-End: 1-409
acccgggctggggggctcggcctgaacctccagtcggcagacactgtgatcatttttgacagcgactggaatcctcaccaggacctgcaagcgcaggaccgagcccaccgcatcgggcagcagaacgaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcg

SEQ ID NO: 187845 - DNA, 534 bp, Homo sapiens
  Payload ID: 16966
  Gene Symbol: SMARCA4
  Gene Name: SWI/SNF related, matrix associated, actin dependent regulator of chromatin, subfamily a, member 4
  ENST ID: ENST00000586985
  CDS Start-End: 1-340
ggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggccagctgatgaccttggccctctcctcccgagatccctgcagcttccaacagtgaggccctccagcagtgaggctgctgattttcatggcctggctggagctgggggcccaggccaggagcagccccaggcaaaaatcacctcccgctgctcttccctgccactcagtactttttctggaataaacatttcctcactgggtg

SEQ ID NO: 187846 - DNA, 7923 bp, Homo sapiens
  Payload ID: 16967
  Gene Symbol: SMARCA5
  Gene Name: SWI/SNF related, matrix associated, actin dependent regulator of chromatin, subfamily a, member 5
  Uniprot ID: O60264
  ENST ID: ENST00000283131
  CDS Start-End: 463-3621
gcgagtgttgaaagtcggtggcgtaggtcgtcgtcctggatgctggcgagatagatgttatcttccagaggaagaggaggaggcggcgaagcgttttcccagcctcagtctctctttcgttttccttttcccttcccccaaccctccgcccttctctaaatcagccggccttccttgacctcagtgacccgtctggccccgcccaccctcgtcgacgtgattcccgccgtgaggtaagcgccggtggaacctagagccccgcggaagagcagaacgtttgggagtgtgcagctcctgggcccggctcaggcccgtcgcggaggcgcggcgcaggggagcgctcgggtgggagtctcgctcctccaccagtttattgcgacgtagcatccaggcctaggcctccccgtccatccccgccggactcgggcctctggcagcagcgggtgacgcagacggaacatcatgtcgtccgcggccgagcctccgccacccccgcctcccgagagcgcgccttccaagcccgcagcctcgatcgccagcggcgggagcaacagcagcaacaaaggcggccccgaaggcgtcgcggcgcaggcggttgcgtctgcggccagcgctggtcccgcagacgccgagatggaggaaatatttgatgatgcgtcacctggaaagcaaaaggaaatccaagaaccagatcctacctatgaagaaaaaatgcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgattaccgacaccgtagaacagagcaagaggaggatgaagagctattaacagaaagctccaaagcaaccaatgtttgcactcgatttgaagactctccatcgtatgtaaaatggggtaaactgagagattatcaggtccgaggattaaactggctcatttctttgtatgagaatggcatcaatggtatccttgcagatgaaatgggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtttgtttgataggagataaagaacaaagagctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaagttgtcagaaatagtgagggaattcaagactacaaatagactattattaactggaacacctcttcagaacaacttgcatgagctgtggtcacttcttaactttctgttgccagatgtgtttaattcagcagatgactttgattcctggtttgatacaaacaactgccttggggatcaaaaactagttgagaggcttcatatggttttgcgtccattcctccttcgtcgaattaaggctgatgttgaaaagagtttgcctccaaagaaggaagtaaaaatctatgtgggcctcagcaaaatgcaaagggaatggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggttcacgagtactaatcttcagtcaaatgacaagggtattggacattttggaagattattgcatgtggagaaattatgagtactgcaggttggatggtcagacaccccatgatgagagacaagactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggaccgagcacatagaattgggcagactaagacagtcagagtgttccgctttataactgataacactgtagaagaaagaatagtagaacgtgctgagatgaaactcagactggattcaatagtcattcaacaagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaagactgcagagatgaatgaaaagctctccaagatgggcgaaagttcacttagaaactttacaatggatacagagtcaagtgtttataacttcgaaggagaagactatagagaaaaacaaaagattgcattcacagagtggattgaaccacctaaacgagaaagaaaagccaactatgccgttgatgcatatttcagggaagctcttcgtgttagtgaacctaaagcacccaaggctcctcgacctccaaaacaacccaatgttcaggatttccagttctttcctccacgtttatttgaattactggaaaaagaaattctgttttacagaaaaactattgggtacaaggtacctcgaaatcctgagctgcctaatgcagcacaggcacaaaaagaagaacagcttaaaattgatgaagctgaatcccttaatgatgaagagttagaggaaaaagagaagcttctaacacagggatttaccaattggaataagagagattttaaccagtttatcaaagctaatgagaagtggggtcgtgatgatattgaaaatatagcaagagaagtagaaggcaaaactccagaagaagtcattgaatattcagctgtgttttgggaaaggtgcaacgagctccaggacatagagaagattatggctcagattgaaaggggagaggcgagaattcaaagaagaataagcatcaagaaagcacttgacacaaagattggacggtacaaagcaccttttcatcagctgagaatatcatatggtactaacaaaggaaaaaactatactgaagaagaagatcgttttctgatttgtatgcttcacaaacttggatttgacaaagaaaatgtttatgatgaattgcgacagtgtattcgcaactctcctcagttcagatttgactggtttcttaagtccagaactgcaatggagctccagaggagatgtaataccttaattactttgattgaaagagaaaacatggaactagaagaaaaggagaaggcagagaaaaagaaacgaggaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgtgactttttgtttattagctataatttctacacttgtaaggcttaaaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggaaaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgattttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaagtggtcttttctttccatttctttaattgttttctcaatttttattcactttttcctttaggacacatttcccttaattggatatctttcccttaaatttctattagtagttgttttcatctgcccacatgtaattgaagatttaaaaaaaaaattttgatacctgcagtattactaatactgcttaatttcttgaaatgtggaattgctgctgttaatgtcaagcaaaacgcagtatttatggcaaattgtaaagtaatttgaatttagtgctacctcaaaattaactttttaaatactatgttagattcttaacagttaaaggtctaatacatgcatgaggaatggttacttatgaaaggaaaaagaatttgtaagagttatcacctcagtttggaagaaattgaaaaaatgtaaggctgaagaaaacttacggaggtcacaaaagtgatgttttcaagaggaggagaaactgggagggagatacacagtggaaatgcaaaatgaatcaagtatagtggtagccctgagagcttagggactcaaatggaaactgtgtgaagggaaactcacttgaaaaaaaagcatgaaccagctaggccctgccaccactgtgtttggccaagttcacaaatctgttttaacctgtcacttccctgtcacttctctggctttcctctcccgctaagcttttgtttcctggcagtaattaaaatcttctgtcagtgccacagctactactgctactggaactgccttaaccactactgctactggaactgccttagccaccttggtatcgtggtttggcaaagtattggcctctaccaccatagggcccagagcttctgcctccaaagtttcctcccttcatgggtccaaaatttgaagactgattgttgtcattgccaaaatcattgtagcttttaccacctccaaaattgcttcaatcattaccaaatctattatagcaatccccactgccaccatatccatcaccaccaccatggctgccaccaaagccaccacgatcacagaacttgatgactgtatttgtgactaattgtataatagtttctgttctgtggaaagtaaagcattccaacacagggtttcagtgtagattgttttgttttgtacccatgctgttgattgctaaatgttttaataatctgatcatgatactgaataaatgtctttttttttttttaacaacaaagcatgaaagattgcttaattgtacatctgacaaagtgctggaggctattataaagtgtaattattactacttttaagagacagggtcttgctctgtcacccaggctggagtgcagtggtgcaatcacagctcactgcaacctcaaacttcagggctcaagtgatcctcccacctcagcttcccaagtagctaggactacagataccacgcccagctaagtttttttagtttttgtagagatagggccttgctatgttgcccagtccggtctcaaacgccgacttcaggcaatcctcttgcgtcaacctctcaaagtgctgggattacatgtgtaagcctacattccaaagtgctgggatcatagttgtgagcctacaccacacctggcctacattttgtttttcataaagttgagagaagcaaatcctaagcatagagtacaagttgagcatccctaatcaaaaaatctaaaatcagaaatgctccataatttgaatgctcattagggcatttctgatttttggattagggatgctgaactgataagtataatgcaagtattctaaagtctggaaaatgctaaaaacacttctggttccaggcatttcagataaggattgctccatctgccctttgagtatttaatatatgccgattgtttgaactaatctggatttaattatataaatgattatataaatgatctttggcttagtacctttcttaatctcgatcttaaaaagcattgtaaaacacccctgtggtttttcagaaaaattctgagtaaaaaataaatttcatcttgttctatccctttgaatctaaaaaacaaatctttttgaaaggatgtgctactatatttcaaaccagtagttttggagtagaacattgctaaaaaaatgggtactaaggagggtaatttaaacaaagtagattaatgacacaaggtggattgatgaactcataaatccaaatgaatggaatgctagaagacatgtattaacggagtagctgttaccaaaatatatacatattttgtatatgtacatagctgttaccaaaatgtatctttgcctgttggaatctgatgtcaagatcaaaggtgagggcatccctcagatgacagataatgggcaaaatacattcttggtgtggagcagtgctgcagaattaacttcgctgtgtacatcccagaatcgttttggatctgttaaggtttttattagaatgattaaataggcttttgcagcattaactttacagtagttaccagaaaagactatgctacaagaaccaaaattgaagtaagaagaaaaagactgaaatgatatgattctaaatgaaaaaaatgaagaagtggaatagtttctccacaggcataagaggcaaagcattgtttcagaagtggactggcacctcacctgagatactcaagactggcaacatgggtctacattctttgttaccacagattcccttgtgtccggagagattccctagctctaatgacagcttttttggggggtaatgaggctatgagaagattgaggatctaggtacttgcctttaactctacagcatacaaggtgtgtggctcttatctctaggacaccaatatttaatgttgcatatcatgtatctccagtacaagaagaaagtttatcagaatttagttaatgttggaaactttgtaatataaacaatgtaaacactacattgacaaaaatattttattaatacaaagaatatgcatatagtttgcttactacagaaattcttgtttttgatgtagacaacccaaaggagtttttatgtatatagattgtgaataaattgggaaaagaaatagagataagtagagattatttcacttcattaaacttttgaagtcctaa

SEQ ID NO: 187847 - DNA, 3271 bp, Homo sapiens
  Payload ID: 16968
  Gene Symbol: SMARCAL1
  Gene Name: SWI/SNF related, matrix associated, actin dependent regulator of chromatin, subfamily a-like 1
  Uniprot ID: Q9NZC9
  ENST ID: ENST00000357276
  CDS Start-End: 331-3195
atcattcttacttttggaagcgaaactgcggccgcgttgcctgctgggaaatgtagttcagcggtggcctagcccttcaggcctggccgctacaataaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatcatggaattgaaataaaataatgtattttgttttaaaa

SEQ ID NO: 187848 - DNA, 3056 bp, Homo sapiens
  Payload ID: 16968
  Gene Symbol: SMARCAL1
  Gene Name: SWI/SNF related, matrix associated, actin dependent regulator of chromatin, subfamily a-like 1
  Uniprot ID: Q9NZC9
  ENST ID: ENST00000358207
  CDS Start-End: 152-3016
aagtggagatcgtaggggtgggagtggggcgtggcgcccgcttaccttgaggctgggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaaggttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatca

SEQ ID NO: 187849 - DNA, 2431 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000392128
  CDS Start-End: 1-2391
cagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgttgccaagagggtgatcctgttgtcgggcacaccagccatgtcccggcccgcagagctctacacgcagatcatcgcagtcaagccaactttcttcccccagtttcatgcctttggacttcgctactgtgatgccaaacggatgccttgggggtgggactactcaggttcctccaacctgggagagctgaagctcctgctggaggaagcagtcatgctgcggcgcctcaagtccgacgtcctttcccagctgcctgccaagcagcgcaagatagtggtgattgccccaggacggatcaatgccaggaccagagctgccctggatgctgcagccaaggaaatgaccaccaaggacaaaactaaacagcagcagaaagatgccctcattctcttcttcaacagaacagctgaagctaaaatcccatctgtcattgaatatatcttggacctactggaaagtggaagagagaagtttttagtatttgcacaccataaggtggtcctggacgcaattacgcaagagcttgagagaaagcacgtgcagcacatccgcatcgatggctccacctcatcagctgagcgggaggacctgtgccagcagttccaactgtcggagaggcatgctgtggccgtgctgtccatcaccgctgccaatatgggcctcaccttctcctcggctgacctggtggtgtttgctgagctgttttggaacccaggggtgctgatccaggctgaggaccgcgtgcaccgcattggacagaccagctccgtgggcattcactacctcgtggcaaagggcacagctgatgactacctttggcccctgattcaagagaagattaaagttctggcagaagccgggctttctgagaccaatttttcagaaatgacagaatccactgattacctctacaaggacccaaagcagcagaagatctacgacctattccagaagtcctttgagaaagaaggaagtgatatggagctcctggaagcagcagagtcctttgacccaggaagtgcttcaggaacatctggaagtagttcccagaacatgggagacaccctggatgaaagctcattgacagccagtccacagaagaaaaggagatttgaattttttgataactgggacagctttacgtctcccctgtaaaaggggcaaaaagaaaaaaataaaaagcattttaaaatca

SEQ ID NO: 187850 - DNA, 538 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000412913
  CDS Start-End: 115-538
attactcctcatactgctttgcctgaccacactacgacctggagaacttggattctagtcctaactctgccctcagtcctcttagatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgatgtcaagaccaggaagtggagctttctcttggaagagcacagtaaactaattgcaaaggtgcgctgcctcccacaagttcagctggaccctctgcccacgactctcaccctggcgtttgcttctcagctcaagaagacatctctcagtctcacgccagatgtcccag

SEQ ID NO: 187851 - DNA, 977 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000427645
  CDS Start-End: 1-977
gaagaaatgcccacagcctgcccaggccacagtccacgtagtcaaatggctctcactggaatctctcctcccttggcacaaagtcctccagaggtccctaaacaacagctcttgagttatgagttaggtcaaggtcatgctcaggcttcacctgagatcaggttcacaccctttgctaacccaactcataagcctctggccaaaccaaagagttcccaagagacaccagctcattcctctggacagcctcccagggatgctaagttagaggccaagacagcaaaagcctccccttcggggcagaacatttcttacatccattctagctcagagagtgtaacgcccaggacagaaggaagactccagcagaagtcagggtcctcagtccaaaaaggagtgaactctcagaagggaaagtgcgtaaggaacggcgatcgtttccaggtgttgattgggtacaatgcggaactcattgcagtgtttaagaccctgcccagcaagaattatgatcctgacaccaagacgtggaacttcagcatgaatgactatagtgccctgatgaaagcagcccagagcctccccacggtcaacctgcagcctctggaatgggcctatggcagcagcgagtcaccctccaccagcagtgagggacaggccggccttccatcagctccatccctttcatttgtcaaagggcgatgcatgctcatctccagggcctacttcgaggcagacatcagttattcacaggaccttattgcgctttttaaacagatggattccagaagatatgttgcaaaggtgcgctgcctcccacaagttcagctggaccctctgcccacgactctcaccctggcgtttgcttctcagctcaagaagacatctctcagtctcacgccagatgtcccagaggcagacctttctgaagtggaccccaagctcgtgtctaatctgatgccctttcagagagctggagt

SEQ ID NO: 187852 - DNA, 310 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000425815
  CDS Start-End: 253-310
ggaagaccggtcccgctcgggaggctctgcagtcgcgcctggggtcagggccgggggcgaatgtggctcgcgttctaggcctccctgggtgagaaagtggtagactggcaggaaggcggcggaggcggacgagaccaatgccagcctggaggaggaagttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaagg

SEQ ID NO: 187853 - DNA, 711 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000444508
  CDS Start-End: 321-711
aaggctggcgaactcgcagcgcttgaatacccgtggcctaaccgtccactcggaagaccggtcccgctcgggaggctctgcagtcgcgcctggggtcagggccgggggcgaatgtggctcgcgttctaggcctccctgggtgagaaagtggtagactggcaggaaggcggcggaggcggacgagaccaatgccagcctggaggaggaagtgggccaatgggaagggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctc

SEQ ID NO: 187854 - DNA, 484 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000445153
  CDS Start-End: 1-484
gagtcaattttgccatagccaaaggaggccgcctgctgctcgctgacgacatgggcctggggaagaccatccaagccatctgcatcgcagccttttaccggaaggagtggccgctcctggtggtggtgccatcctccgtgcgcttcacctgggagcaggccttccttcggtggctgccatctctgagcccagattgcatcaacgtcgtggtgactgggaaggaccgcctgacagctggcctgatcaacattgtcagctttgaccttcttagcaagttggaaaaacagctaaaaaccccttttaaagttgtcatcattgatgaatctcacttcctcaaaaacagtaggactgcccgctgtcgagcagctatgccggtcctaaagcatacggtgaacatttattggttacttggcgtcaggcatatgctacagaaaataaaggttgccaagagggtgatcctgttgtcgggcacaccagccatgtc

SEQ ID NO: 187855 - DNA, 544 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000434435
  CDS Start-End: 268-544
agtggggcgtggcgcccgcttaccttgaggctgggtgaggctcgccccgaaatgcggggcgtggggggcggggggcagaggtccctgcctagaggggaagaggggcgtccatgtggcggaatggatttatggtttggggctgatcagtgggtcttatggccgagtctctctggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttc

SEQ ID NO: 187856 - DNA, 722 bp, Homo sapiens
  Payload ID: 16968
  Gene Symbol: SMARCAL1
  Gene Name: SWI/SNF related, matrix associated, actin dependent regulator of chromatin, subfamily a-like 1
  ENST ID: ENST00000430374
  CDS Start-End: 286-722
atcattcttacttttggaagcgaaactgcggccgcgttgcctgctgggaaatgtagttcagcggtggcctagcccttcaggcctggccgctacaataaggctggcgaactcgcagcgcttgaatacccgtggcctaaccgtccactcggaagaccggtcccgctcgggaggctctgcagtcgcgcctggggttggaaaaagactatgttagcaagtgtcacgccatgcttttgccaactttccaattaaaggttgacattcctgcataagcatttctctgtgaaaatgtccttgcctcttacagaggagcagaggaaaaagattgaagagaatcgacaaaaggctctggcccgcagagctgagaagttattggcagaacagcatcagaggactagctcgggcacctccattgctggcaacccattccaggccaagcaaggcccatcccaaaatttcccaagggagtcttgtaagccagtgagccatggtgtcattttcaagcaacagaatctcagtagctcatctaatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaagg

SEQ ID NO: 187857 - DNA, 1690 bp, Homo sapiens
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENST ID: ENST00000263121
  CDS Start-End: 197-1354
ctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaa

SEQ ID NO: 187858 - DNA, 1728 bp, Homo sapiens
  Payload ID: 16969
  Gene Symbol: SMARCB1
  Gene Name: SWI/SNF related, matrix associated, actin dependent regulator of chromatin, subfamily b, member 1
  ENST ID: ENST00000344921
  CDS Start-End: 208-1392
aacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccactttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaa

SEQ ID NO: 187859 - DNA, 1643 bp, Homo sapiens
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENST ID: ENST00000407422
  CDS Start-End: 177-1307
ggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaa

SEQ ID NO: 187860 - DNA, 1182 bp, Homo sapiens
  Payload ID: 16969
  Gene Symbol: SMARCB1
  Gene Name: SWI/SNF related, matrix associated, actin dependent regulator of chromatin, subfamily b, member 1
  ENST ID: ENST00000407082
  CDS Start-End: 160-1179
gcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaacca

SEQ ID NO: 187861 - DNA, 889 bp, Homo sapiens
  Payload ID: 16969
  Gene Symbol: SMARCB1
  Gene Name: SWI/SNF related, matrix associated, actin dependent regulator of chromatin, subfamily b, member 1
  ENST ID: ENST00000417137
  CDS Start-End: 208-889
aacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccactttgatgaccatgacccagctgtgatccatgagaacgcatctcagcccgaggtgctggtccccatccggctggacatggagatcgatgggcagaagctgcgagacgccttcacctggaacatgaatg

SEQ ID NO: 187862 - DNA, 1690 bp, Homo sapiens; identical to SEQ ID NO: 187857
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENST ID: ENST00000618915
  CDS Start-End: 197-1354

SEQ ID NO: 187863 - DNA, 1728 bp, Homo sapiens; identical to SEQ ID NO: 187858
  Payload ID: 16969
  Gene Symbol: SMARCB1
  Gene Name: SWI/SNF related, matrix associated, actin dependent regulator of chromatin, subfamily b, member 1
  ENST ID: ENST00000629690
  CDS Start-End: 208-1392

SEQ ID NO: 187864 - DNA, 1643 bp, Homo sapiens; identical to SEQ ID NO: 187859
  Payload ID: 16969
  Gene Symbol: SMARCB1
  Gene Name: SWI/SNF related, matrix associated, actin dependent regulator of chromatin, subfamily b, member 1
  Uniprot ID: Q12824
  ENST ID: ENST00000631333
  CDS Start-End: 177-1307

SEQ ID NO: 187865 - DNA, 1182 bp, Homo sapiens; identical to SEQ ID NO: 187860
  Payload ID: 16969
  Gene Symbol: SMARCB1
  Gene Name: SWI/SNF related, matrix associated, actin dependent regulator of chromatin, subfamily b, member 1
  ENST ID: ENST00000630853
  CDS Start-End: 160-1179

SEQ ID NO: 187866 - DNA, 889 bp, Homo sapiens; identical to SEQ ID NO: 187861
  Payload ID: 16969
  Gene Symbol: SMARCB1
  Gene Name: SWI/SNF related, matrix associated, actin dependent regulator of chromatin, subfamily b, member 1
  ENST ID: ENST00000629656
  CDS Start-End: 208-889

SEQ ID NO: 187867 - DNA, 242 bp, Homo sapiens
  Payload ID: 16969
  Gene Symbol: SMARCB1
  Gene Name: SWI/SNF related, matrix associated, actin dependent regulator of chromatin, subfamily b, member 1
  ENST ID: ENST00000635578
  CDS Start-End: 1-242
tctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccactttgatgaccatgacccagctgtgatc

SEQ ID NO: 187868 - DNA, 269 bp, Homo sapiens
  Payload ID: 16969
  Gene Symbol: SMARCB1
  Gene Name: SWI/SNF related, matrix associated, actin dependent regulator of chromatin, subfamily b, member 1
  ENST ID: ENST00000634926
  CDS Start-End: 1-269
tctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccactttgatgaccatgacccagctgtgatc

SEQ ID NO: 187869 - DNA, 6375 bp, Homo sapiens
  Payload ID: 16970
  Gene Symbol: SMARCC1
  Gene Name: SWI/SNF related, matrix associated, actin dependent regulator of chromatin, subfamily c, member 1
  Uniprot ID: Q92922
  ENST ID: ENST00000254480
  CDS Start-End: 121-3438
ggctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaacctaaacatttggccccacctggtcttggtttgatcagcagttaaaattctgtgactcgggcttccttcccgactgcccaccttcatgatgtgtaaggaacatacattttgagggtacctcacccactgttcatttgcatggtcaaagtgaaaatgagtggaagttctccaaaaatgatggccaacatcctggcacctccaggtgtgagaaatagctttgcttggtgaatgggataatgtttgtcaggatgcagtttagacagtcccaagttggaggcaggccttgagggcagaagattctgtgaaccttgggggacagcttttgggtactcacagatataaaccctgtgcagaaaaaaagaagtgattgttttcaggatgcttataaatcgagtgaagcaaaagaagaggattctgtgtctgccatgagatgaacgccctgctcttcacgaaggtgtgcctctaataaagagagccaaagccagctgggtctcaccagattcctatactttctcaaggatgttgggggaggttaatcctttatcgaaactaaagactggtttat

SEQ ID NO: 187870 - DNA, 636 bp, Homo sapiens
  Payload ID: 16970
  Gene Symbol: SMARCC1
  Gene Name: SWI/SNF related, matrix associated, actin dependent regulator of chromatin, subfamily c, member 1
  ENST ID: ENST00000454240
  CDS Start-End: 85-486
gcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatgaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcct

SEQ ID NO: 187871 - DNA, 4076 bp, Homo sapiens
  Payload ID: 16971
  Gene Symbol: SMARCC2
  Gene Name: SWI/SNF related, matrix associated, actin dependent regulator of chromatin, subfamily c, member 2
  Uniprot ID: Q8TAQ2
  ENST ID: ENST00000267064
  CDS Start-End: 88-3732
gcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggatt

SEQ ID NO: 187872 - DNA, 3839 bp, Homo sapiens
  Payload ID: 16971
  Gene Symbol: SMARCC2
  Gene Name: SWI/SNF related, matrix associated, actin dependent regulator of chromatin, subfamily c, member 2
  Uniprot ID: Q8TAQ2
  ENST ID: ENST00000347471
  CDS Start-End: 88-3480
gcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaa

SEQ ID NO: 187873 - DNA, 4271 bp, Homo sapiens
  Payload ID: 16971
  Gene Symbol: SMARCC2
  Gene Name: SWI/SNF related, matrix associated, actin dependent regulator of chromatin, subfamily c, member 2
  Uniprot ID: Q8TAQ2
  ENST ID: ENST00000394023
  CDS Start-End: 107-3565
gcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgctt

SEQ ID NO: 187874 - DNA, 3730 bp, Homo sapiens
  Payload ID: 16971
  Gene Symbol: SMARCC2
  Gene Name: SWI/SNF related, matrix associated, actin dependent regulator of chromatin, subfamily c, member 2
  ENST ID: ENST00000552674
  CDS Start-End: 13-330
gagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatgaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggatt

SEQ ID NO: 187875 - DNA, 4114 bp, Homo sapiens
  Payload ID: 16971
  Gene Symbol: SMARCC2
  Gene Name: SWI/SNF related, matrix associated, actin dependent regulator of chromatin, subfamily c, member 2
  ENST ID: ENST00000550164
  CDS Start-End: 16-3753
cccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaa

SEQ ID NO: 187876 - DNA, 789 bp, Homo sapiens
  Payload ID: 16971
  Gene Symbol: SMARCC2
  Gene Name: SWI/SNF related, matrix associated, actin dependent regulator of chromatin, subfamily c, member 2
  ENST ID: ENST00000550519
  CDS Start-End: 83-400
gggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatgaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctg

SEQ ID NO: 187877 - DNA, 3237 bp, Homo sapiens
  Payload ID: 16972
  Gene Symbol: SMARCD1
  Gene Name: SWI/SNF related, matrix associated, actin dependent regulator of chromatin, subfamily d, member 1
  Uniprot ID: Q96GM5
  ENST ID: ENST00000381513
  CDS Start-End: 171-1595
agcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaa

SEQ ID NO: 187878 - DNA, 3658 bp, Homo sapiens
  Payload ID: 16972
  Gene Symbol: SMARCD1
  Gene Name: SWI/SNF related, matrix associated, actin dependent regulator of chromatin, subfamily d, member 1
  Uniprot ID: Q96GM5
  ENST ID: ENST00000394963
  CDS Start-End: 399-1946
ttggaaagttaacgccatgcgccaagatgaagctattactccaagcccctcttcatcagagggctcgagttggggttgagactggggctgaggctgtggtccgtccccctttccaggtccttgtcttcctcccgtcggcctgggggcgcccgctcacgcggcctctctattgcagagctcttctctatggttttccctcccggaccgtgaaggcgggagggcgtggccagcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattagccac

SEQ ID NO: 187879 - DNA, 881 bp, Homo sapiens
  Payload ID: 16972
  Gene Symbol: SMARCD1
  Gene Name: SWI/SNF related, matrix associated, actin dependent regulator of chromatin, subfamily d, member 1
  ENST ID: ENST00000551966
  CDS Start-End: 46-881
tccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagtcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtg

SEQ ID NO: 187880 - DNA, 611 bp, Homo sapiens
  Payload ID: 16972
  Gene Symbol: SMARCD1
  Gene Name: SWI/SNF related, matrix associated, actin dependent regulator of chromatin, subfamily d, member 1
  ENST ID: ENST00000549274
  CDS Start-End: 1-346
gacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtttggaacaaactctcccttcacttgttgccctgtagcactacagaaaccctggttcttgggctccactgagccccagaggctgttccttcctgctgtttggagatgtgactcattcattcac

SEQ ID NO: 187881 - DNA, 911 bp, Homo sapiens
  Payload ID: 16972
  Gene Symbol: SMARCD1
  Gene Name: SWI/SNF related, matrix associated, actin dependent regulator of chromatin, subfamily d, member 1
  ENST ID: ENST00000550477
  CDS Start-End: 43-911
ggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagtggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacc

SEQ ID NO: 187882 - DNA, 2095 bp, Homo sapiens
  Payload ID: 16972
  Gene Symbol: SMARCD1
  Gene Name: SWI/SNF related, matrix associated, actin dependent regulator of chromatin, subfamily d, member 1
  ENST ID: ENST00000548573
  CDS Start-End: 5-946
agttatgtgcaatggtttgcttaacttgcctcatttcccttgggcaaatgagatggccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggttttt

SEQ ID NO: 187883 - DNA, 536 bp, Homo sapiens
  Payload ID: 16972
  Gene Symbol: SMARCD1
  Gene Name: SWI/SNF related, matrix associated, actin dependent regulator of chromatin, subfamily d, member 1
  ENST ID: ENST00000551497
  CDS Start-End: 198-536
agtgcgcagaaagagagggggaggcagttacacacctgctcctaggggcattgtttccctggggagtcggtagagaacctgggtgggtgaagtgggtccagggatacctgtatgagggccggagtgcaaaggggcttgagcagctccagtgatcagaggaacacagaacgtgtagctgacaaattgagagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtccc

SEQ ID NO: 187884 - DNA, 1800 bp, Homo sapiens
  Payload ID: 16973
  Gene Symbol: SMARCD2
  Gene Name: SWI/SNF related, matrix associated, actin dependent regulator of chromatin, subfamily d, member 2
  ENST ID: ENST00000225742
  CDS Start-End: 96-1466
agtaccaggtgagcaaggaggacgcgagcggacgggggcgagaggcgctgcgagggcgcccgggccggcggctgaaggggcctcgacgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctg

SEQ ID NO: 187885 - DNA, 1935 bp, Homo sapiens
  Payload ID: 16973
  Gene Symbol: SMARCD2
  Gene Name: SWI/SNF related, matrix associated, actin dependent regulator of chromatin, subfamily d, member 2
  Uniprot ID: Q92925
  ENST ID: ENST00000323347
  CDS Start-End: 48-1499
agtgtgtgcaaggcagagctgccaaacaggccttgcaggcagcagccatggggaggcgggtgggggtggaggtgactcccagatgggctccacagaaatgtcagggagcaaggcctcagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctac

SEQ ID NO: 187886 - DNA, 2716 bp, Homo sapiens
  Payload ID: 16973
  Gene Symbol: SMARCD2
  Gene Name: SWI/SNF related, matrix associated, actin dependent regulator of chromatin, subfamily d, member 2
  Uniprot ID: Q92925
  ENST ID: ENST00000448276
  CDS Start-End: 267-1862
ggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtcta

SEQ ID NO: 187887 - DNA, 993 bp, Homo sapiens
  Payload ID: 16973
  Gene Symbol: SMARCD2
  Gene Name: SWI/SNF related, matrix associated, actin dependent regulator of chromatin, subfamily d, member 2
  ENST ID: ENST00000450364
  CDS Start-End: 1-694
ggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaa

SEQ ID NO: 187888 - DNA, 449 bp, Homo sapiens
  Payload ID: 16973
  Gene Symbol: SMARCD2
  Gene Name: SWI/SNF related, matrix associated, actin dependent regulator of chromatin, subfamily d, member 2
  ENST ID: ENST00000577990
  CDS Start-End: 241-449
tcgcgaggggcaggattcgaggaggcactcgagcattgggcaccaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgca

SEQ ID NO: 187889 - DNA, 477 bp, Homo sapiens
  Payload ID: 16973
  Gene Symbol: SMARCD2
  Gene Name: SWI/SNF related, matrix associated, actin dependent regulator of chromatin, subfamily d, member 2
  ENST ID: ENST00000580054
  CDS Start-End: 1-330
cgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgagtaagtgttaagaggacacctgggaggcctgcccagtggccaccttgggatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgc

SEQ ID NO: 187890 - DNA, 1017 bp, Homo sapiens
  Payload ID: 16973
  Gene Symbol: SMARCD2
  Gene Name: SWI/SNF related, matrix associated, actin dependent regulator of chromatin, subfamily d, member 2
  ENST ID: ENST00000584400
  CDS Start-End: 25-267
ggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccaggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcat

SEQ ID NO: 187891 - DNA, 2342 bp, Homo sapiens
  Payload ID: 16973
  Gene Symbol: SMARCD2
  Gene Name: SWI/SNF related, matrix associated, actin dependent regulator of chromatin, subfamily d, member 2
  ENST ID: ENST00000613943
  CDS Start-End: 1-1485
atgtcgggccgaggcgcgggcgggttcccgctgcccccgctaagccctggcggcggcgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattg

SEQ ID NO: 187892 - DNA, 1993 bp, Homo sapiens
  Payload ID: 16974
  Gene Symbol: SMARCD3
  Gene Name: SWI/SNF related, matrix associated, actin dependent regulator of chromatin, subfamily d, member 3
  Uniprot ID: Q6STE5
  ENST ID: ENST00000262188
  CDS Start-End: 412-1863
cgcgggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggcggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 187893 - DNA, 1669 bp, Homo sapiens
  Payload ID: 16974
  Gene Symbol: SMARCD3
  Gene Name: SWI/SNF related, matrix associated, actin dependent regulator of chromatin, subfamily d, member 3
  Uniprot ID: Q6STE5
  ENST ID: ENST00000356800
  CDS Start-End: 130-1542
ctggcatcttcctcccctcctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctg

SEQ ID NO: 187894 - DNA, 2018 bp, Homo sapiens
  Payload ID: 16974
  Gene Symbol: SMARCD3
  Gene Name: SWI/SNF related, matrix associated, actin dependent regulator of chromatin, subfamily d, member 3
  Uniprot ID: Q6STE5
  ENST ID: ENST00000392811
  CDS Start-End: 476-1888
gtgcgcgcccacgtgcatgcgcgtgtgtggtcctagtgtaggtgatgtctgcggccacacaggatgctgactgcgtgtgtgactcgtgggcgtgcagatgcaagcacaggcctacgacacatctgtgtacaggctgaagatcacaacgggtctggccagggcccgccgagggcctccgagctggcgagcacaccgacggctggatggggcgacgcttcctgctccggtccctaactcattattaagctcctcgctctttgcagacgctccctgcgcctcccccgctccgggctgcagcggcgcaggcgccgggccgagccgagcgccgagcagggagcgggcggccgcgctccgggccggggtcccgggggagcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 187895 - DNA, 820 bp, Homo sapiens
  Payload ID: 16974
  Gene Symbol: SMARCD3
  Gene Name: SWI/SNF related, matrix associated, actin dependent regulator of chromatin, subfamily d, member 3
  ENST ID: ENST00000485592
  CDS Start-End: 1-206
ccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaaggtgccttagttcggggcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcaggtg

SEQ ID NO: 187896 - DNA, 2415 bp, Homo sapiens
  Payload ID: 16974
  Gene Symbol: SMARCD3
  Gene Name: SWI/SNF related, matrix associated, actin dependent regulator of chromatin, subfamily d, member 3
  ENST ID: ENST00000469154
  CDS Start-End: 70-291
gatcctcagaatggcccttggtgctgcaggcgcggtgggctccgggcccaggcaccgagggggcactggatgactctccaggtgcaggaccctgccatctatgactccaggtcttcagcacccacccaccgtggtacagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaaggtgccttagttcggggcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcaggtaacctctctcctgaaccctgggatctggggagcaggcggagttctccagcaggggaagtacctctaccaaggtaactaccacccctcccttctagattcctgagtagcagaagcagtacacagtcatggtcttggagccaagagaccgaccaggattctagttcaggccctactgtggattagctctgtgctgcagccaatccatgttagcccccccaagttaggaagacctggaaaccctacaaagccaaccgctttctggaatgtaatattcttggcacttggagttaggatccccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttattaatgcatttaaaaataaatacagcagataaacctgaggagtaaaaatagcagttgatatttattgggcacttaccatgtgccaggcactgtcccaagcactttatgtgtattagttcactgacttctcacggcagccctgggagataggtattcttttcatccccactctagagatgaagacactgagccctgaggtgttaacttgctccaggttgcatagtaagtggcagaggcaggactgatacataagcaggctgacccagggcccgcactctcaacccctgccccacactgacccaccccctatcttgtcagccataccggtggctccaccaccagaccagcccaccccaatcccatccccatgcgcactgaggaatcagacttcctctcagcttcttgtggcctttctagaacaaaaggatctacaactgcatgatgatctcttcaagaagagtgatctctctctccccaattgtcctgcttcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgac

SEQ ID NO: 187897 - DNA, 613 bp, Homo sapiens
  Payload ID: 16974
  Gene Symbol: SMARCD3
  Gene Name: SWI/SNF related, matrix associated, actin dependent regulator of chromatin, subfamily d, member 3
  ENST ID: ENST00000491651
  CDS Start-End: 197-613
aaatgcttggcaggctccctgcccgctggctgcttagggaggtgctcccacttcccccgccgttgcctgagctctctagggctccttcactctgcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaag

SEQ ID NO: 187898 - DNA, 5840 bp, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENST ID: ENST00000348513
  CDS Start-End: 782-2017
tggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttagtttttctaaagagggtcgggtggggcccggaaaaaaaaaaaaattaagaagagtgtggaaagtgcgagtgcggaagctccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaggtctcagtgtttttaatgcactacatatttgtatgcaagacaagcatccagtttttttctgtaatgcagtgacagtgtggaatgaccactcagccattataaatttgtgtactcagggcccttgtctcacccaactatctctataaactgctgcagtagcttatttgtacaagacacttgtgaaaatcagttttcttacattatagtcattgtcacatatggaagttggtctttgattccaaaagtaaagggaatatgtttctacattaacaggaatatggagaaatctgtaacgtttgaattatctttgaaagaatggctaaatgataaatgttaagtcctgtgcctatatggagaggactctgtaccagcatgagttaatttaagtggattcactgctattcagttcatagcacattagtgactaggaatgtgtgttcagcctcctgagagaggaggggaggaagcttgatactgggtggaaacaactcttgacatctgtttccttgtgtgtcaaagaacgaatttgtatcaaatagatctgttttgagctttggccattatttggctaagaacttcagccatctcatctcagacaaattggacagcctctttgatacattttctagtagtcaaaatggggcagatgtagtttaatatgggtggaaaactgccccagcaagataccaggttatttactgtggtatcgaaagctctaagagaatggaagtggttcttttgcccggctggaaatagcagtgggaagacaagtctatccagaccaagcctgtccatacaacactggcaatcagttgatgagggaattaagtcagatgggagacgtctcaatctgtcgcccaggttggagtgcagtggtggcgatctcagctcactgcaacctccacctcccaggttcaagcaattctctctgcctcagcctctagagcagctgggattacaggctctcgccaccatgcccggttaatttttgtattttttagtagagatggggtttcaccatgttagccaggctgatcttgaactcgtgacctcaggtgatccgcctgcctcagtctcccaaagtgctgggattacaggcgtgagccactgtgcccggcctcagttgggatttgacagctctgaacctcagcaggggaagattgatgtaaaaatccacttggtcagagtgatatatgtagacttgatgtttgagatggttctcagtttagagaatgtgggatatggtagaggtctttgtttttttcccatgtcccaaaaggtgctgggcaagtagcttgaactcgagcctgttttaattataaaatagatcaaactgctctttcttggtgcccttactgctccttgatttttagtgcatttattttgagtatgaatgcataaagtctgagggcctaaattttgttaattttttttaacaaatgggagaggggaatcctcgatagtcacccaattttcctttttttttgagacagtctgactgttgcccaggctggagtgtaatggcgccatctcggctcactgcaacatccagctcctgggtttcagcaattctcctgcctcagcctcctgagtagctgggattacaggcgcccgccaccacgcccggctaatttttgtatttttagtagagacaggattttgccatgtttgccagcctggtctcgaactcttgacctcctgatccaccctcctctgcctcccaaagtgctgggattacaggcgtgagccaccgcgcccagccccatagtcccccaattttctaacagttttaaattctgtaacttctcctgtctgtaaacaaggctgtcttttcaaatggctctcctacaggatgtgataattatctattctataaagccgaggtttggagaggtaaatagctatttcacattaacacaataatgtcaatgccctatggaaaagataaaatacttggactatattttaaaggggaatctggggtcatgcatattgaagtttaactagatccctccagatttttggttttgatcctacacatttagatactagttttggattttagacagttggtgctgacagtgtgaaactcctattgcctgcagttaaattgaagctttggtttctcgtgaacaggcagtgaagctggtattatactttaagtcctcatttcagaaatagtttccctccacccccaagcactaccacacatggtctccccacctggtttcagctagtgcattagttttatcttgttttttaccgctgggcaaaccttgctggaacaacaactgacttcatgatttgcacatttggagggcttaacgtctttgcaaatgaaaaatccactgtacaataacaagctcaaaggaactcggagcctttttagaagaaatcgtgctgaattataatgtggcttactgcaataatgtttctttgatcaggatggaaaggaaaatactgagtttagcagaaaacgatgtctaaatgtatttgtaatgatacaattgtttataaatgttttactattaggttgaaccataagaaattgccagtgtacaatttcatctacaaaatgactggcttaacctaaattctgcattttatactccaagaataagctcttcgtggcagctttctaagtgtgaaatgatggaactttctatttgccagaatgacctacacttctctaatagtttatctcatattgttagccaaacgctgattaaaatgcaaatttcaaacta

SEQ ID NO: 187899 - DNA, 1307 bp, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENST ID: ENST00000377808
  CDS Start-End: 92-1078
caaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacagcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttg

SEQ ID NO: 187900 - DNA, 536 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000447024
  CDS Start-End: 1-474
cttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaaggtaaaaaataataataataacttgtataaataaaacttacataaagta

SEQ ID NO: 187901 - DNA, 1263 bp, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENST ID: ENST00000400122
  CDS Start-End: 153-1034
caaagggaagcgaagccggagctgcgggcgctttttctgcccgcggtgtctcagattcattcttaaggaactgagaacttaatcttccaaaatgtcaagcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttg

SEQ ID NO: 187902 - DNA, 1569 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000431889
  CDS Start-End: 71-1252
aggggcggggcgagcgcgggacaaagggaagcgaagccggagctgcgggcgctttttctgcccgcggcaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatg

SEQ ID NO: 187903 - DNA, 695 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000481231
  CDS Start-End: 105-272
ggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggagatttcctaggaccttgctcttctgtaagcacagttctacccgcctccccattggaaattgaaagcagaaaattggaaagagagttgctgctagaggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatgg

SEQ ID NO: 187904 - DNA, 1228 bp, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENST ID: ENST00000580419
  CDS Start-End: 92-1222
caaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacagcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttg

SEQ ID NO: 187905 - DNA, 449 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000577721
  CDS Start-End: 145-449
caaagggaagcgaagccggagctgcgggcgctttttctgcccgcggaaagaccatcttatgccccacctcccaccccagctcctgcaacagcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgag

SEQ ID NO: 187906 - DNA, 1090 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000478349
  CDS Start-End: 225-1090
gagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacatggctatacaggtggagctgaacaattgagattctgacctcaaagagctaaccatgtacttcagctttggaaatgcaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaa

SEQ ID NO: 187907 - DNA, 621 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000582955
  CDS Start-End: 235-621
gaggcctccttgaggcctagcagagcgagggttgggagggagtcccatctggggccccctccttggaggcaaggccagtcccccgaaattggtcaaagcacctgtgaataccccgttttaggggagttgctagtaaagtacattctccaagacaaagagagcgacctcaggaagccgtgggcaaggcagtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatct

SEQ ID NO: 187908 - DNA, 2124 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000474246
  CDS Start-End: 88-321
gggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggtaggagaatcaactattacagcatccggcaaacaactggaattgaccagaaatgccttcagaattaggtctttttgaatcataagcacagccatttaaaaaaaattttttaacctagctttttgagtattttcaacattcgttgtagcatctcacactgaaaaaataaatagtgagatctggaatgtatatagaagaaaagaaaaatccattctgtttggtggttggtagggttaaagccttgagcacttgatgcttatactgtatgtaaacaaacagaatttcttaaggtaaaaatatcctttttgacataaagagtatttttcatttttataaggtgattggcattagtctcaaggattgagtttctagtagaggctggtctttcagacctggctttttcagggctggaaagcttttggctggtacaccagtttgaatcgctacccatagttatttgtcttttggatttagtagttgaccttctaactaagactcatttctctacagtgaaaaagagaaaaacgttttaatgtcacctcaaagaaatgcagagtgaaggttgaatgaaattaatttgaagtatcagactagatatgtacaacgagaagtgcatttctaatccttagtataagagataggatttctgaaacttagcatgtttcatttaagtgatcagcctaagatatcaaaattggatgatacacttcaaatcttttagtttagaatcatcttaaatttcattcaaaaaagtttaagcaccaaaaaatgccaataattataaaaatgacttactaaagataaaaaatccaaaagtcaaatactacattggaatgtagtgttggtgagaatttatacaacccagaatggctgtaaagtttttaatacctggtttttgtttgctgtattcataaataacaagtgccttctattaatgtaacttcaaaaaagccctctcaccctgtagtcaagctggaactgaaagcttgtagctatcaaatgaatgtctatcttgataagcatattgcttagcttgataggttttgtttgtctaaatttttcattgtttctgcataatatgtacttcataagcatatcaagttttatgtgccatgcatatttcatggtatctgaaaaagaattctgacaaagtgtgtgtatgtatgcatttcacaatgcatacaatttttatgtgcatcaatacatgtttttccctggcctaaacatgttgtttcacaagtgtaatggatggcaaggttttcaaatgataaagaacatttcagtttaaacaatgaacggaatcaatcatggatcttaatgttaatgcagcaattttttcacgggcagtaaacaagaatgattgcatttaatagctctatacagtcacctcttgattatctatgttaatggaatagaaatgataactataatattacagtaatttgtcttttggttttgtgtaagtattttgctcttaacttggatgtagctgtgggggattctcagttaaaaaagtgagattgttcgatggagactaggaagagaaagtgtactccctatctgaagtcactcatctgtttcttcccattccttcttggcgaatgttaagaactgaacatttggcgtggacactagctacatagtagattaattatagagagttgttggacatggaaaatttggtgttttggtcctttgtggacatttactttgtattattgtcctcttaacaccaaattgaagtataatcaaactgctatatgaagaagggcctagaaaatgtggaggttttacactacttgccctgctttctatatctagtttaagctgttaggactcaatggctctgattttgaccataataaaagcattttgatttta

SEQ ID NO: 187909 - DNA, 554 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000580654
  CDS Start-End: 94-554
caaagggaagcgaagccggagctgcgggcgctttttctgcccgcggaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgag

SEQ ID NO: 187910 - DNA, 2384 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000578112
  CDS Start-End: 115-273
cgaggggcggggcgagcgcgggacaaagggaagcgaagccggagctgcgggcgctttttctgcccgcggtgtctcagattcattcttaaggaactgagaacttaatcttccaaaatgtcaacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaaatgaaaaaaaggt

SEQ ID NO: 187911 - DNA, 1184 bp, Homo sapiens
  Payload ID: 16975
  Gene Symbol: SMARCE1
  Gene Name: SWI/SNF related, matrix associated, actin dependent regulator of chromatin, subfamily e, member 1
  Uniprot ID: Q969G3
  ENST ID: ENST00000578044
  CDS Start-End: 153-1178
caaagggaagcgaagccggagctgcgggcgctttttctgcccgcggtgtctcagattcattcttaaggaactgagaacttaatcttccaaaatgtcaagcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttg

SEQ ID NO: 187912 - DNA, 631 bp, Homo sapiens
  Payload ID: 16975
  Gene Symbol: SMARCE1
  Gene Name: SWI/SNF related, matrix associated, actin dependent regulator of chromatin, subfamily e, member 1
  ENST ID: ENST00000264640
  CDS Start-End: 1-532
aatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaaaaaaattgccagctctgtcctagaaaaacccttacttctaggtatactgattttcctgattaaaagcatccctcaaggaaacagcccagcatgactttaaacaaagtgtctaaaagaccaaccttatattatttctacaactgctttctcctcgtttaatcc

SEQ ID NO: 187913 - DNA, 4912 bp, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENST ID: ENST00000354268
  CDS Start-End: 74-3154
gggaacgtgcctgcgcgtgcttggatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaagatttgttaatttttggaaatcatgcttttcaaagcatcctaacttgctaagatgctaggtagtacgaccctctggatttggaaggcaaataaaactcttacagtgattatttagatattaaagactgagaactcacggcttaaccccagtcttgatggtatattgaacagactgaatatattttaccattacagggctaaaaggagtcttcatgtgttaatactacctccttgtacatcactatacccaaatcagttattcaaattgttaggaattttaccttttaaaatctcataatggatatctcatgttttctgtattaatgtattttcaatgataggctgtttctttttttgttgttattgttgttgttgttatatccatacttttatctctaatgaaatgtagttgggttcttcctgtaatgcgctattatgtcttgggcttaataaaaatatttgtgatcataa

SEQ ID NO: 187914 - DNA, 5017 bp, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENST ID: ENST00000359052
  CDS Start-End: 175-3261
attacgcgctcttaaggtttctccgtggtgttttggaaggtcccggcacggctaccgtcgccccacgctaggaaattttttttttattttcaacctttgttacatagcactgaggctacaagatcatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggtcacagaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaagatttgttaatttttggaaatcatgcttttcaaagcatcctaacttgctaagatgctaggtagtacgaccctctggatttggaaggcaaataaaactcttacagtgattatttagatattaaagactgagaactcacggcttaaccccagtcttgatggtatattgaacagactgaatatattttaccattacagggctaaaaggagtcttcatgtgttaatactacctccttgtacatcactatacccaaatcagttattcaaattgttaggaattttaccttttaaaatctcataatggatatctcatgttttctgtattaatgtattttcaatgataggctgtttctttttttgttgttattgttgttgttgttatatccatacttttatctctaatgaaatgtagttgggttcttcctgtaatgcgctattatgtcttgggcttaataaaaatatttgtgatcat

SEQ ID NO: 187915 - DNA, 3778 bp, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  ENST ID: ENST00000394961
  CDS Start-End: 209-421
gcatgagggtcagctcgtggtttcagtaaggaggggcgggcgggggaggcggacgaaggggagtgaaaagcaatggaaaattttaaaagatacccccgtccaccttctaattgttgcggcctaacaatgaagcgcagccataacagtcctgagccactgatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagtgagtttggagggattgaaataatggcaggtgaaagggaagagagatcctactatattttatgaataaagaataaaaatgagtgaagcctgatcctccaagagcaccaggagaaaatgaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggtcacagaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactgga

SEQ ID NO: 187916 - DNA, 4649 bp, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENST ID: ENST00000457823
  CDS Start-End: 276-3362
ctctcagctgggatcgcgccgcgtcaacttccgggcggatgcccgccagcacggcctccgccgctccccttctttggcccctttgtgtccccgcagtgtcgaggcgcgggccctggcaggtcctttctcgaggcagggggcacggtagcacagggagcttctctttgtgggcgggcgcgaggcccgctagggggttatactggggaacgtgcctgcgcgtgcttggatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcatggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggtcacagaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaa

SEQ ID NO: 187917 - DNA, 2348 bp, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  Uniprot ID: Q9H4L7
  ENST ID: ENST00000509418
  CDS Start-End: 388-2178
aagaaattagagcttacatttaggaaggagttgtttgctagcctgttctgatctgttactgctgagacaccatgcagaaagcaagaatgtggcagaaattttactacaactacttgaagagcaatagcaacggccaggggagctccatgattcaaaatgccagcctaagtgttttatgcttcaccacaaaagaagcaattgtttattttctttttttcttctaaaagtaacagctcagtctctaacatgtttttgttggttaagcaacgtggccattttatggagtgtagcaggctgcagcgtttttaattggaaagatagaaaaatttctggaagcctataattcaagcgttaggtgaagggaaggcataagcactgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagacaaaatcagcagatgagcaaagcatatatgaaaaggagagaatagcacatgcaaaacaaattataaagccatttattctcagaagagtaaaagaagaggttctcaagcagttaccccccaagaaagatcgaattgagttgtgtgcaatgtcggagaagcaggagcaactctatttgggtcttttcaacagattgaaaaaatctatcaataacttggaaaaaaacacagaaatgtgcaatgtcatgatgcagttgaggaaaatggccaatcatcctttattacatcgccaatattacacagctgaaaaactcaaggaaatgtctcagcttatgctaaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaagggtgatagagttgtgttatttagccaatttaccatgatgctggatatcttagaggttctattaaaacatcatcagcataggtacctcagattagatggaaagactcagatttctgaaaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaaagaagtactagttataaaactaataagccaagggacgattgaagaatccatgctaaaaattaaccaacagaaattgaaactagaacaggatatgactacagtagatgaaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaat

SEQ ID NO: 187918 - DNA, 2409 bp, Homo sapiens
  Payload ID: 16976
  Gene Symbol: SMARCAD1
  Gene Name: SWI/SNF-related, matrix-associated actin-dependent regulator of chromatin, subfamily a, containing DEAD/H box 1
  ENST ID: ENST00000510105
  CDS Start-End: 255-989
cgtcaacttccgggcggatgcccgccagcacggcctccgccgctccccttctttggcccctttgtgtccccgcagtgtcgaggcgcgggccctggcaggtcctttctcgaggcagggggcacggtagcacagggagcttctctttgtgggcgggcgcgaggcccgctagggggttatactggggaacgtgcctgcgcgtgcttggatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtttctgagccatctgaagatgaagagtcccaaggccttcctaccatggcacgtagaaatgatgatatttcagaactggaagacctttcggaattggaagaccttaaagatgctaaacttcagactttgaaggaactttttccacaaagaagtgacaatgatttacttaagttgattgaatcaacaagcactatggatggagcaattgctgctgccttgctgatgtttggtgatgcaggtggtgggcccaggaaaagaaaattatcttcttcttcagagccatatgaggaagatgaatttaatgatgatcaatctataaaaaagacaagactggatcattgtgcctgggctgtaaaggtggcagtatgaattttgaagattttgaaatggtttctccagatgggtttcaccaggagaggaatcaaatgagtctgcagaatctagcagtaattgggaaaagcaggaaagtattgtactgaaattgcaaaaggaatttcccaattttgataaacaggaacttagagaagtactcaaggaacatgaatggatgtacacagaagctttagaatctctaaaagtgtttgcagaagaccaagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctgttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaagtttgtcactcaagccctatcagaaggttggtttgaattggctggcattggtacataaacatggacttaatggcattttggcagatgaaatgggcctaggaaaaactattcaagccattgcatttctggcatacctctatcaggagggtaataatggtcctcatttgatcgttgttccagcttcaactatagataactggttaagggaagttaatttatggtgccctactttgaaggtcctctgttactatggttctcaagaagaacgtaaacaaattagatttaacattcatagtagatatgaagattacaatgtaattgtgaccacatataactgtgcgatcagcagttctgatgaccgtagtctgtttcgacggctgaaacttaattacgcaatttttgatgagggccatatgctgaagaatatgggctccattcgctaccagcaccttatgacaattaatgcaaataaccgtttgctgctcacaggcacacctgtacagaacaatctgttagaactcatgtcgctgttgaattttgttatgccacacatgtttagtagtagcaccagtgaaatacgaagaatgttttcctctaagaca

SEQ ID NO: 187919 - DNA, 980 bp, Homo sapiens
  Payload ID: 16977
  Gene Symbol: SWI5
  Gene Name: SWI5 homologous recombination repair protein
  Uniprot ID: Q1ZZU3
  ENST ID: ENST00000320188
  CDS Start-End: 1-708
atgcagcggcgtggccagagggacctgtggcgtcacaacaaaagctgcgcacgcaaccgctgtccccgcccacctcgggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactg

SEQ ID NO: 187920 - DNA, 699 bp, Homo sapiens
  Payload ID: 16977
  Gene Symbol: SWI5
  Gene Name: SWI5 homologous recombination repair protein
  ENST ID: ENST00000372898
  CDS Start-End: 1-437
ggtccttggagacccgagaccaaagaaccccgggaggtccggtttggggcggcaggaggactgaaccaagacttacccgaagttgccgcggggccttccgatcccctttccttccagcaacctttgagaagacgctttactgtccccatgttgagaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtat

SEQ ID NO: 187921 - DNA, 763 bp, Homo sapiens
  Payload ID: 16977
  Gene Symbol: SWI5
  Gene Name: SWI5 homologous recombination repair protein
  ENST ID: ENST00000418976
  CDS Start-End: 98-490
tccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactga

SEQ ID NO: 187922 - DNA, 466 bp, Homo sapiens
  Payload ID: 16977
  Gene Symbol: SWI5
  Gene Name: SWI5 homologous recombination repair protein
  ENST ID: ENST00000495313
  CDS Start-End: 30-449
cagcgcgacgtccaagtcgccgctccgcgatgggggaggggaccgcagggccaggacccaggtccttggagacccgagaccaaagaaccccgggaggtccggtttggggcggcaggaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgcccct

SEQ ID NO: 187923 - DNA, 906 bp, Homo sapiens
  Payload ID: 16977
  Gene Symbol: SWI5
  Gene Name: SWI5 homologous recombination repair protein
  ENST ID: ENST00000608796
  CDS Start-End: 120-632
gggagaggggcggggccggctttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactagctgtgatccgaggtgtcaccaccaaagagttgtatccagagtttgggctggacatgaatgactgagcaggctcatcgccccttgtccacagctcccagggacagaagggtgtggacatgataaacactgagagcccaaccagcacacctacagagtttccagcgagacaatgccagaagcacttttctagagagcccaagcccaatcaggaggaggctagagaagaggcgggcagggaggaaggggcgttcccagctccaaggttcctgaaatgtcgcagtgatacttgtgtaggggtacatgtactttatttgtcaataaacgtatctgtacactgat

SEQ ID NO: 187924 - DNA, 1048 bp, Homo sapiens
  Payload ID: 16977
  Gene Symbol: SWI5
  Gene Name: SWI5 homologous recombination repair protein
  ENST ID: ENST00000419867
  CDS Start-End: 100-555
tttccttgggtgcgcgcgcagctttctgtgcgccagttcacactccgggtcagagttcctggcccggtgcacctgagaggtcgctctccgactcccgcgctggaccctcttgcgccattgaaccccctgatccgggggcctcggaccccagggctcaggagatggatccagtccctggcgctcctacttcccaactgctcctcctcccgcatccccacagtaccccgtcctcacagcgggctgtgggtccaatcagactttcccctcggattcctctctaggactgaaccaagacttacccgaagttgccgcggggccttccgatcccctaggccattgcccaagtctggccaggctgatgggaccagcgaggagtctctgcaccttgacattcagaaactgaaggagaagagggacatgctggacaaggagatctcccagttcgtatctgaaggctacagtgtggatgaactggaggaccacattacccagcttcacgagtacaatgacatcaaggatgtggggcagatgctgatgggcaaactaggtgagtagttgggactccagagccacaagcaggcatcatagggtgtcgtctcgcctaggggtgttgggttttgctcctgggcctcccagcttgccaaccgtcacaccctcagcagttggcctgctcctaggctgccccagcccctctcctgaccagcctctggtctccctggccacctaggtttgttcctcaagtacagaacctgctttggagccgcagccaggtttgagcggggcttgcccatctgccagactgagaactcagggtctccccagtcttctgggacctactcagagtgatcaagataccgtccatgcctcaagtggctagcttgctaaagaggctgcaagtgcaagggtgaccctttgtgtcttaaggaagtattttgtttcctccctgaacaaaatcttgctatctagagggctttagccgaggcaccaacacctgtatgtcatgctggctaggacagcctaccttggaggtgaggaaatgtgcaggcgg

SEQ ID NO: 187925 - DNA, 1438 bp, Homo sapiens
  Payload ID: 16978
  Gene Symbol: SFR1
  Gene Name: SWI5-dependent homologous recombination repair protein 1
  Uniprot ID: Q86XK3
  ENST ID: ENST00000369727
  CDS Start-End: 20-757
ttttttgctctcgctgggaatggcggagggagagaaaaaccaagatttcactttcaagatggaaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcactttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccata

SEQ ID NO: 187926 - DNA, 1503 bp, Homo sapiens
  Payload ID: 16978
  Gene Symbol: SFR1
  Gene Name: SWI5-dependent homologous recombination repair protein 1
  Uniprot ID: Q86XK3
  ENST ID: ENST00000369729
  CDS Start-End: 124-822
agcggcgcctcgcgcgtcaggcaatctggccaattgcgcatcttttccgcctaccgcacggccccgcccctgccacaggatcgatttacggccgcagagaaaaaccaagatttcactttcaagatggaaagtccgtcagactcagctgtggttttacctagcactcctcaggcctctgcgaatccatcatctccctatacaaatagttcccgaaaacaacctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcactttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctcagaggaaggtatcccaatgaatatcaattaagggcactttaatatataaattataaactaagttctaaaaggaaaattagtattttggatagatttgtcaaaacgacatttaagtcatgtttaaaaagtcatttgggcagttctggaaactagttttaatacatttgttttttatgacaaaaagttttattttaaatgttaaaaattgtccaatctggtgaatgtctaaccctaaagtttaaaaatttctgcctcctaagtttatgtaccttgtttccatccatttaccacatatttccatctgatagtctagcaggtaattaaacttatatgtccaaaaccata

SEQ ID NO: 187927 - DNA, 1684 bp, Homo sapiens
  Payload ID: 16979
  Gene Symbol: SWSAP1
  Gene Name: SWIM-type zinc finger 7 associated protein 1
  Uniprot ID: Q6NVH7
  ENST ID: ENST00000312423
  CDS Start-End: 60-749
cggagacgctgaggcgggtgctaaccaggggcggtgcggcctggtccggggaggagaacatgcctgccgccggaccgcctttgctgctgctcggtacaccaggatctggaaaaacagcgctgctatttgctgcggccctagaggcggcgggggagggccaaggcccagtcctcttcctgacacgaaggcctcttcaaagcatgccccgcgggaccggaacgactctagacccaatgcgactccagaagatccgcttccagtacccaccctcaacccgagagcttttccggctcctgtgctctgcccatgaggccccggggccagccccctcccttctgctgctcgacggcctagaagagtacctagcggaagacccagagccccaggaagccgcctacctcattgccttacttctagacacagctgcccacttcagccaccggcttgggcctggccgggattgtgggctcatggtggccctccagacccaggaggaagcaggtagtggggacgtcctgcacctggcactgctccagcggtattttcctgcccagtgctggctgcagccagatgcaccaggtccaggagagcacggcctccgagcctgcctggagccaggcgggctgggccccagaacagagtggtgggtgactttccgatcagatggagaaatgatgatcgctccgtggcccacccaggctggtgaccccagctcaggcaagggttcaagctctggaggccagccctgagctttggtgggtgactacctctctgtgcttcagtttcccatggctggaatacttacctcagggacatatgcagatccaaagacctaaacaatgtaaagtgctttttctcttttaaaagtatagcattatcttgtatatattttacccaatcaatatgttgtttatagtttcattgctttaaactttataaaaagagcttcaggccaggcgtggtggctcacgcctgtaatcccagcactttgggaggctgaggcggtcagatcaccagaggtcaggagttggagaccagcctgcccaacatgatgaaaccctgtatcaactaaaagtacaaaaaaaattagctgggtgtggtggcaggtgcctgtagtctcagctactcaggaggcttaggcaggagaattgcttgaacccaggaagcggaggttgcagtgagccgagattgtgccactacactccagcctgggtgacaaagcgagactccatctcaaaaaaaaaaaaaaaaaaaagtttgagacttccttctttttgcactcaacgttgttactaagattcatctacatttttttagttcattcctttttccatattgcatataattccatgggtgactataccctgatttcttcatcagattgccttatttactgctgcgaacattcttgcacacatgccctggtacgtgtgtgtgtttttaggggccgagacaggtggatcacctgaggtcaggagttcgaggtcagcccggcctacatggtgaaaccccgtctctactaaaaatacaaaatttagccaggcatggtggcatgcacttgtactcccagctacttgggaggctgagacaggagaattgcttgaacccgggaggcagaggttgcagtgagctgagatcgagccactgcactccagcctgggtgatgaagacgagactctgtctc

SEQ ID NO: 187928 - DNA, 3830 bp, Homo sapiens
  Payload ID: 16980
  Gene Symbol: SWT1
  Gene Name: SWT1 RNA endoribonuclease homolog
  Uniprot ID: Q5T5J6
  ENST ID: ENST00000367500
  CDS Start-End: 166-2868
ggggcggtgagtaggtagtgcggatgcgggcgcagaactacgtttcccagcaggcatacagttggtggggcggggtgtgtgtgtgtgttgggaggcgggggtccctctcctttggcttggggctccggagttgccactgccgccggcgctggtaagcttttcaggatgtccagcaaagaatcctgtgggaaaaaagagacatctcagaggaaagacaccaccacctcatcacccaattttggtgaaaaagacaagaaagagagaaaaaccccagcaagttctactagttcatcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagctagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcaactcttctggagttcacaatgcctccctacctctattcttgatagtgagccagtatctctaaggaaaggagagccgtatttttagtcatcctagggcaggagccactgtggcatctgaggaagacccagggtacagtattagcatttctttcaaccctaagtatgggcatgtgaccagagacactgccaaaccctaagaaatcattagggcatgatcatgctcaccatatttcacaaatgaaatcttaatgtgggctgttttttatgatcaaactgtcatccatgttgacctgatgaaaataacaccctccttcacctccctcagggtaatgaaagtagaaatttgactgaagctcctacttccttatacagcctttccttctgtgggcttgtcacttttcagtacatttctagtggggaagagcagggcgacccctctgctgggtttctccttaaatgtgaagcaaaataaatttatataatggaatttggtggcagtgactgatgtttgtctctagctaaaaccaactgtttagttgactttttagttataggataagttggaagtccttgtttactggaatatattatgcttttgttaacacattagattaaatagaatttggtattctattataaatgtttattttttaaagcaataaataacttatttttggtaagatttggctttttacttccaaattgtttctgatatgtacataaggtatgattataaaagtgactgtctgcaataaaa

SEQ ID NO: 187929 - DNA, 3001 bp, Homo sapiens
  Payload ID: 16980
  Gene Symbol: SWT1
  Gene Name: SWT1 RNA endoribonuclease homolog
  Uniprot ID: Q5T5J6
  ENST ID: ENST00000367501
  CDS Start-End: 95-2797
aggatacactgcgcagtctgggggcggggccggagttcaagcctcggaggaagtaaatgcaaatctaagcgagcgctgtggggcgcttttcaggatgtccagcaaagaatcctgtgggaaaaaagagacatctcagaggaaagacaccaccacctcatcacccaattttggtgaaaaagacaagaaagagagaaaaaccccagcaagttctactagttcatcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttagtagtcctaagattgccagtgatgtgaaacctaaagccgaaggccaggcaagtgaaaataaatggtctcatttacttgttcagagagagaagatgaaagaactcaagaaaggaagaaacagtaaatttagagacaattctgaaaaatgtgtcttagagaaatggaagagaaatcaattttctcaggattataactccaacaagataattaaggaacccttgggatctagaagacagaagatcagtttcaaaatccctataaaatcccgtgacaccctccagaaacttgtagaagaaaatgtcttcaacatagattctaataattcgaagactaagcaggaagaaagagaatacctggaaagctcccaggtttcattaaatgtgactaggcagaaaactgaacatttactttcagattttacatataagcggactgttcatgagtggaaacgaaaacatcattatgaccatcaagaaagtaatgattcacattctagggaaaacctaacccagagttttgaagcaccatgttgttccgtgtcatctgaaagtatccaggatgcagatcaagagatgcagatagtagaagagcttcatgctgcacgtgtgggaaaaagtgtggatttacctggagagttaatgagtatggaaattgacttagaagatgatgtacattcctcctctgcaaataatacttcagacagaaagcttctaattgttattgacacaaatattctgatgaatcatctcaaatttgttagaattttgaagacaacagaagtaccaggttttgacaaacttgtgttaataattccctgggtcgttatgcaagagctagatcgtatgaaggaaggaaaactactaaaacgtgcccagcacaaagctatacctgcagttcatttcatcaacgacagtctcaaaaatcaagatagaaagctatggggtcagtcaatacaacttgcatcccaaaaacattatggattgagtgatgagaacaatgatgatcgagtactaaaatgctgtctccagcaccaggaattattcccttgttcttttgttattctgtgcacggatgatagaaacttaagaaacaaaggcctaataagtggtgtgaagtcactcagtaaagaagaattgagtgcagagttattacacttatctctgaacacagatgtgtgtcatcagccttgtattcctaagcaacagttgaaagcagaaacaacacccttgaaagagagctataaggaggaatctacaaattctggactgtccattctgcttgagagcattgtatctgatcttgaaaaatctcttggaacaggtttatcttcaatattagaaacagaaatgaaaattgcttttggaaacctttggatggagatcctgtacctgaaaccaccatggactctactacatttactacagtgctttaaaaaacattggttggctgtatttggattagttatggaaaagaacttgcttttaactattgagagcctatacaaaaatctccgtaaagctaataaggcagtggattttacaacagtcaaattcttgcttcaggattctagaagtttgttacatgctttcagtacaaggtcaaattatgatggtattcttccacagacctttgctcaagtaaacaacctccttcagacatttgcagaggtcaagacaaaacttaagccaaattcttcagaaaacacagtgactaaaaagcaggaaggtacttcattgaagaattctcataatcaagaaatcactgttttctcgagttctcatcttccccaacccagcaggcatcaagaaatctggtctatcctagagagtgtttggattacaatatatcagaacagcacggatgtatttcaaagattgggctcaaattcagctctgactacttcaaatatagcatcatttgaagaagcatttatatgtcttcaaaagttaatggcagctgtgagggatattcttgaaggaattcaaaggattttggccccaaacagtaattatcaagatgttgagaccctctataacttcctaatcaagtatgaggtaaataaaaatgtcaaatttactgcccaggaaatttatgattgtgtttctcagactgagtatagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactc

SEQ ID NO: 187930 - DNA, 633 bp, Homo sapiens
  Payload ID: 16980
  Gene Symbol: SWT1
  Gene Name: SWT1 RNA endoribonuclease homolog
  ENST ID: ENST00000450350
  CDS Start-End: 155-633
gggtgtggttctggcccggcttgcctccggggctgccccttgcccggtgttggggtctggtcggttcgtgcggagcccgcgggcccgcggcggtttactagcagctgacgagcttgcctgtccatccagctgacttggaattaggcttttcaggatgtccagcaaagaatcctgtgggaaaaaagagacatctcagaggaaagacaccaccacctcatcacccaattttggtgaaaaagacaagaaagagagaaaaaccccagcaagttctactagttcatcttctataagatcagtttcatcagaaaagagaaaactgaaatcagatcatacagatgttctgtactataatataaaaagaagacaaggactgaaaagattgagtgtagaaattgacactctcagaaggagaccaaaaatcggttcttcatcccaaagacctattaaactcaaagaagcatcatattcaaatgataatcaaattattttgcagagtccttcttcaaatggaactaaaaaagacatacataaatgtgtagactttaaacctaaagatatcaaattgacaaatgctgggagcaagcttgaccatggaattaaaagccttagtagtcctaagattgccagtgatgt

SEQ ID NO: 187931 - DNA, 1345 bp, Homo sapiens
  Payload ID: 16981
  Gene Symbol: SYF2
  Gene Name: SYF2 pre-mRNA-splicing factor
  Uniprot ID: O95926
  ENST ID: ENST00000236273
  CDS Start-End: 27-758
ggaagtgggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatctttgaagcattttgggcttaagattgccagcagcacacatcagatgcagtcattgttgctatcagtgtggaatttgatagagtctagactcgggccacttggagttgtgtactccaaagctaaggacagtgatgaggaagatggcagtggccaccggaggactggagcagtccctcctcatggcggcctgtgaccaaggtcggggaggagtggagctatccttccatgatctgatcatgtacagttccctttttaaaaagcaataaatgcttgggattagaatttctaa

SEQ ID NO: 187932 - DNA, 926 bp, Homo sapiens
  Payload ID: 16981
  Gene Symbol: SYF2
  Gene Name: SYF2 pre-mRNA-splicing factor
  Uniprot ID: O95926
  ENST ID: ENST00000354361
  CDS Start-End: 20-625
ggaagagagaaaggttgtgatggcggctatagctgcatccgaggtgctggtggacagcgcggaggaggggtccctcgctgcggcggcggagctggccgctcagaagcgcgaacagagactgcgcaaattccgggagctgcacctgatgcgggaatgtgcggcaagaggagaagactatgagaaagtgaagttgctggagatcagtgcagaagatgcagaaagatgggagaggaaaaagaagaggaaaaaccctgatctgggattttcagattatgctgctgcccagttacgccagtatcatcggttgaccaagcagatcaaacctgacatggaaacatatgagagactgagagaaaaacatggagaagagtttttcccaacatccaatagtcttcttcatggaacacatgtgccttccacagaggaaattgacaggatggtcatagatctggaaaaacagattgaaaaacgagacaaatatagccggagacgtccttataatgatgatgcagatatcgactacattaatgaaaggaatgccaaattcaacaagaaagctgaaagattctatgggaaatacacagctgaaattaaacagaatttggaaagaggaacagctgtctaatcccttcaagaactgtttatagaagcttgagaatggggtaaaaatttctgctagcaaaatcaagttctttttgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatgtattttaaatgtatatggctgtttaatcttt

SEQ ID NO: 187933 - DNA, 4195 bp, Homo sapiens
  Payload ID: 16982
  Gene Symbol: SYMPK
  Gene Name: symplekin
  Uniprot ID: Q92797
  ENST ID: ENST00000245934
  CDS Start-End: 246-4070
ggaaatgaagggtctgctcgccgtagtatggaggcgggcagaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaa

SEQ ID NO: 187934 - DNA, 503 bp, Homo sapiens
  Payload ID: 16982
  Gene Symbol: SYMPK
  Gene Name: symplekin
  ENST ID: ENST00000602061
  CDS Start-End: 78-503
aatttgttatccgactcttatctgtgtgctgttttatgatgtctatgaccgtgtgttccatgaagctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcag

SEQ ID NO: 187935 - DNA, 653 bp, Homo sapiens
  Payload ID: 16982
  Gene Symbol: SYMPK
  Gene Name: symplekin
  ENST ID: ENST00000596824
  CDS Start-End: 1-286
cccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagagctgcccccagcgcccccttcctgctctccacccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgacc

SEQ ID NO: 187936 - DNA, 560 bp, Homo sapiens
  Payload ID: 16982
  Gene Symbol: SYMPK
  Gene Name: symplekin
  ENST ID: ENST00000601600
  CDS Start-End: 410-560
agagctgtgtttttaaaagtttactctgggccaggcactgtggttcacgcctgtaatccctgcactttgggaggccgaggcaggtggaacacctgaggtcaggagtttgacaccagcctggccaacatggtgaaaccctgtctctactgaaaatacaaaaattagctgggcatggtggcatgtgcccgtaatcccagttacttgggaggctgaggcaggagaatcacttgaacctgggaggcagaggttgcagtgagctgagatcgcaccaccacactccaacctgggtgacagagcaagacttcatctcaaaaaaaaaaaaaaaagaaagtttgctgtggtgcccagtccaaagcatatcccagatggagagaggggacacacggagacctgcaagctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaa

SEQ ID NO: 187937 - DNA, 611 bp, Homo sapiens
  Payload ID: 16982
  Gene Symbol: SYMPK
  Gene Name: symplekin
  ENST ID: ENST00000598059
  CDS Start-End: 199-611
gtgcgcaccgttcccggcgacgaacggaagatggcggcggcggcggcggcggagtgtaggaagaggcactgctgagggggcgcgaggggaacggaggccagagctgcggtgttcgggtgacaatccagcccagcccatccgctggttccctgagcttgatccatcctcttctttcctggggacaagctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaa

SEQ ID NO: 187938 - DNA, 623 bp, Homo sapiens
  Payload ID: 16982
  Gene Symbol: SYMPK
  Gene Name: symplekin
  ENST ID: ENST00000594293
  CDS Start-End: 278-623
atttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgggtctcactctgtcgcccaggctggcacgatcccagttcactgcaacctccacctccctggttcaagtgattctcccaccccagcctctcgagtagctgggattacaaacgtgccccaccacacccagctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaaca

SEQ ID NO: 187939 - DNA, 5164 bp, Homo sapiens
  Payload ID: 16982
  Gene Symbol: SYMPK
  Gene Name: symplekin
  ENST ID: ENST00000600237
  CDS Start-End: 1313-3334
cccaggctgctctccgactcctaggctcaagcgatctgcctgcctcagcctcccaaagtgttgggagtacaggcatgagccactgcacctggcctcatttttcttttttttttgtaaaacagaaacatacagtcaacactgtcttcagctttgcttgttttcacttaatgtatgcactctctatcagtgtctagagattgttctcatttttttgtttttttcttcctttcttgttacagttccatagtctttttcctttatttatatttatatgtttttcacttactttcacaggtgttgaagccccatggcctttgattatgtatgaactttttttcagccagtctccctatttgagaacacttgagttgcttctagtcttttgctattatgaatagttgtgtaattgacatatactgctacgttaatcattccataattttgcctgtgtgactgtgatggatgcctgaaagcccccttcctcccttttaaaaacagcttcatgatattccagagagtggctgaaacataattattgaagcaggccttttgtgatgtattgagtgcctactatgtgccggactctgtgcctgatattcctcagagctgtgtttttaaaagtttactctgggccaggcactgtggttcacgcctgtaatccctgcactttgggaggccgaggcaggtggaacacctgaggtcaggagtttgacaccagcctggccaacatggtgaaaccctgtctctactgaaaatacaaaaattagctgggcatggtggcatgtgcccgtaatcccagttacttgggaggctgaggcaggagaatcacttgaacctgggaggcagaggttgcagtgagctgagatcgcaccaccacactccaacctgggtgacagagcaagacttcatctcaaaaaaaaaaaaaaaagaaagtttgctgtggtgcccagtccaaagcatatcccagatggagagaggggacacacggagacctgcaaggtggctgttgcacgttcatgtggcccatcgttcagcagctgtttgtggttggcccacttgaggctgagacttctggctctgccttgggagatgtcagtctcccccaagttacaggccccgtgcacatatccataagccagagacagaccctggaggggagagggacttgagaaggcctgactggggaggaacagcctgggaaggaggcttgggccctttgtaggtgttcgggtgacaatccagcccagcccatccgctggttccctgagcttgatccatcctcttctttcctggggacaagctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggc

SEQ ID NO: 187940 - DNA, 6537 bp, Homo sapiens
  Payload ID: 16982
  Gene Symbol: SYMPK
  Gene Name: symplekin
  ENST ID: ENST00000599814
  CDS Start-End: 1216-4392
tttttcttttttttttgtaaaacagaaacatacagtcaacactgtcttcagctttgcttgttttcacttaatgtatgcactctctatcagtgtctagagattgttctcatttttttgtttttttcttcctttcttgttacagttccatagtctttttcctttatttatatttatatgtttttcacttactttcacaggtgttgaagccccatggcctttgattatgtatgaactttttttcagccagtctccctatttgagaacacttgagttgcttctagtcttttgctattatgaatagttgtgtaattgacatatactgctacgttaatcattccataattttgcctgtgtgactgtgatggatgcctgaaagcccccttcctcccttttaaaaacagcttcatgatattccagagagtggctgaaacataattattgaagcaggccttttgtgatgtattgagtgcctactatgtgccggactctgtgcctgatattcctcagagctgtgtttttaaaagtttactctgggccaggcactgtggttcacgcctgtaatccctgcactttgggaggccgaggcaggtggaacacctgaggtcaggagtttgacaccagcctggccaacatggtgaaaccctgtctctactgaaaatacaaaaattagctgggcatggtggcatgtgcccgtaatcccagttacttgggaggctgaggcaggagaatcacttgaacctgggaggcagaggttgcagtgagctgagatcgcaccaccacactccaacctgggtgacagagcaagacttcatctcaaaaaaaaaaaaaaaagaaagtttgctgtggtgcccagtccaaagcatatcccagatggagagaggggacacacggagacctgcaaggtggctgttgcacgttcatgtggcccatcgttcagcagctgtttgtggttggcccacttgaggctgagacttctggctctgccttgggagatgtcagtctcccccaagttacaggccccgtgcacatatccataagccagagacagaccctggaggggagagggacttgagaaggcctgactggggaggaacagcctgggaaggaggcttgggccctttgtaggtgttcgggtgacaatccagcccagcccatccgctggttccctgagcttgatccatcctcttctttcctggggacaagctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaaggtgaggcgcttcccccccactccagtggcctggcccctgcgacgccagggcaggacctcagtcacccacatgcccccactggaatctgccaagtcaaagactgtcactcacagccccacctcagagctctggagagccacctccctccctccctccttttcttgcctcctcttccctccctccctccctccctcctccttccttcctcccaggttttaccctttacaacccacctttttctgcctctgatgtacctgctgtgccctggcacagagtgggcctaaagcagttgggtagccccacccctagccccgaggaacagaaggaagcagggcacaccgtgagtggtagaggcgcagcagcagggcagacccagggctccagggcacttgtgggccagggtaggtgaggcaggagagcttgcctgcagggcggcagggttggtgacgaactggccgcctcacgatggcccccactcactgagcactctgcgctgggctctccctgaacgcctacaggcctgagcctgctggtccgccacttggtgggtatgttcacttccattgtgtagacaggaaatggaggctccagagaggttaggtgacttactcagggccaagcagaagctaagtggtgtggtagaagaaacagaatctgaagtgaaacggacctgggtgggaatcccagctctgccggttccgcgtctaaggaccacctcccctgagagcgcccacccctccatccctcctgagcaaggtttctgggccaggagccatcctgtcccacggagctggacaccctcactgtcgccctctatactcagaagactgctgtcctttgatttctcttctcaccctcagacgggaaggggcttcctctctgtgctgcttactttcgtgttctagcttgaaacagcttttcagtgacttacttcctaaccttcctctgcaagttctctgagaaacgtttaaggtcaagagagcagcttatggaaatgtcaaacccacattataaaacccaggaggcaccaaggcctctcgtgggagaccagcagggaggaaagatctccaggctcataggccagggctgtggtcttcacattccccgacccctttggtgatctgaggaaagttctagcccattcccaggacagtatgctcatattatttgcatacagtttgagggggttcacacatacacacacacaccccaaggccatttgtggacccagattagaagccctgaggatcctaggtccagaagaaagggccttgtcggaggccacacaggccaccaggagccaggcccctgaagatccttggcccaggagaaagggccttgccagaggccacacaggccaccaggagtgaggcccccagaggggtcagcagggcctaccctacaccaccccacccttcaacacgcccaggcgtgcacgctgcaggccagacaaccctccagctggtgtccccagcacccaacccaagtttttctcctgctcaggcaccagcagtcttcctggttgcactctaagctccagatcacaaagtcgagtccttttgttgtgcactgttcactcccccgtagaccaccctgttcctctggggagcttgtctataactagacccactcctggtagtccagcattaagaaaagtcagcacctctgctcacccatatccatcctgggtagtgctggggacacaggaaagacagccctagccctgtccttccagggcttacagtccagggagagacaagaagtccctggccagtaacaactgagaggggtggcctgggactgggcagcccagaggggccatgtaacccagcctgggtgtgggacatcagggaagacttcccgaaaaaggggacactcaggctgagaccaaggaaggatgagtaggcggcagcagcaggagactgcagggaccgagggaggtgcttgctggctggttctggacctaggggacgaaggagggggcctggtcaagggaggaggtcaggctgtcgccattgggaaaggtgcccctggggcctgcccacacaggagtctcgcaggccgaggtgggaatttgaccttgtttcttgagggtctctgggaggcaagtcaggtctgagctttccaaaacacccttcaggctgctatatggagaatggatcggaggctcgggggaggcccaggtggggggctggggcaaagccgacagggaaggaagaggggaggggtgattctggagccttggggtggctgagcaggcaggaccagtgaccacctggccctgacgaggagcaggggcttcctcggtttctggcaggtcctcacctccactgtctgctctgcccattcagcctcctccccacctgtctacgcccccccccttagagaccccacccctgttctccattagcctctcaaggatttggggg

SEQ ID NO: 187941 - DNA, 5449 bp, Homo sapiens
  Payload ID: 16982
  Gene Symbol: SYMPK
  Gene Name: symplekin
  ENST ID: ENST00000599460
  CDS Start-End: 86-3262
ggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaaggtgaggcgcttcccccccactccagtggcctggcccctgcgacgccagggcaggacctcagtcacccacatgcccccactggaatctgccaagtcaaagactgtcactcacagccccacctcagagctctggagagccacctccctccctccctccttttcttgcctcctcttccctccctccctccctccctcctccttccttcctcccaggttttaccctttacaacccacctttttctgcctctgatgtacctgctgtgccctggcacagagtgggcctaaagcagttgggtagccccacccctagccccgaggaacagaaggaagcagggcacaccgtgagtggtagaggcgcagcagcagggcagacccagggctccagggcacttgtgggccagggtaggtgaggcaggagagcttgcctgcagggcggcagggttggtgacgaactggccgcctcacgatggcccccactcactgagcactctgcgctgggctctccctgaacgcctacaggcctgagcctgctggtccgccacttggtgggtatgttcacttccattgtgtagacaggaaatggaggctccagagaggttaggtgacttactcagggccaagcagaagctaagtggtgtggtagaagaaacagaatctgaagtgaaacggacctgggtgggaatcccagctctgccggttccgcgtctaaggaccacctcccctgagagcgcccacccctccatccctcctgagcaaggtttctgggccaggagccatcctgtcccacggagctggacaccctcactgtcgccctctatactcagaagactgctgtcctttgatttctcttctcaccctcagacgggaaggggcttcctctctgtgctgcttactttcgtgttctagcttgaaacagcttttcagtgacttacttcctaaccttcctctgcaagttctctgagaaacgtttaaggtcaagagagcagcttatggaaatgtcaaacccacattataaaacccaggaggcaccaaggcctctcgtgggagaccagcagggaggaaagatctccaggctcataggccagggctgtggtcttcacattccccgacccctttggtgatctgaggaaagttctagcccattcccaggacagtatgctcatattatttgcatacagtttgagggggttcacacatacacacacacaccccaaggccatttgtggacccagattagaagccctgaggatcctaggtccagaagaaagggccttgtcggaggccacacaggccaccaggagccaggcccctgaagatccttggcccaggagaaagggccttgccagaggccacacaggccaccaggagtgaggcccccagaggggtcagcagggcctaccctacaccaccccacccttcaacacgcccaggcgtgcacgctgcaggccagacaaccctccagctggtgtccccagcacccaacccaagtttttctcctgctcaggcaccagcagtcttcctggttgcactctaagctccagatcacaaagtcgagtccttttgttgtgcactgttcactcccccgtagaccaccctgttcctctggggagcttgtctataactagacccactcctggtagtccagcattaagaaaagtcagcacctctgctcacccatatccatcctgggtagtgctggggacacaggaaagacagccctagccctgtccttccagggcttacagtccagggagagacaagaagtccctggccagtaacaactgagaggggtggcctgggactgggcagcccagaggggccatgtaacccagcctgggtgtgggacatcagggaagacttcccgaaaaaggggacactcaggctgagaccaaggaaggatgagtaggcggcagcagcaggagactgcagggaccgagggaggtgcttgctggctggttctggacctaggggacgaaggagggggcctggtcaagggaggaggtcaggctgtcgccattgggaaaggtgcccctggggcctgcccacacaggagtctcgcaggccgaggtgggaatttgaccttgtttcttgagggtctctgggaggcaagtcaggtctgagctttccaaaacacccttcaggctgctatatggagaatggatcggaggctcgggggaggcccaggtggggggctggggcaaagccgacagggaaggaagaggggaggggtgattctggagccttggggtggctgagcaggcaggaccagtgaccacctggccctgacgaggagcaggggcttcctcggtttctggcaggtcctcacctccactgtctgctctgcccattcagcctcctccccacctgtctacgcccccccccttagagaccccacccctgttctccattagcctctcaaggatttggggggttggggtgctcttctggctcaataaagacttcctggttgac

SEQ ID NO: 187942 - DNA, 6129 bp, Homo sapiens
  Payload ID: 16983
  Gene Symbol: SYAP1
  Gene Name: synapse associated protein 1
  Uniprot ID: Q96A49
  ENST ID: ENST00000380155
  CDS Start-End: 94-1152
tctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcaactatttatttaactttgcatctgctgccacaaaaaagataactgaatcagttgctgaaacagcacaaacaataaagaaatccgtagaagaaggaaaaatagatggcatcattgacaagacaattataggagattttcagaaggaacagaaaaaatttgttgaagagcaacatacaaagaagtcagaagcagctgtgcccccatgggttgacactaacgatgaagaaacaattcaacaacaaattttggccttatcagctgacaagaggaatttccttcgtgaccctccggctggcgtgcaatttaatttcgactttgatcagatgtaccccgtggccctggtcatgctccaggaggatgagctgctaagcaagatgagatttgccctcgttcctaaacttgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcagaggcagtacggcccaaaacgccacccgttgtaatcaaatctcagcttaaaactcaagaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcacactatggagattatgcctcactactcaaagagtgtggctcaggaaccagtgtagcttggccatgccctggcagtatgttggaaatgcctgccccagaccagttgatgttactaagaacgcccaggggatgagaatggactttatttacagtttgggaagcactggtctaatatgctctcagggaagctgaggtttctactgctttttactttttacccttccactagatgtcctttgcagcagtgtttttctagttggcattacaggtgtctcctctgaggttccagttatttctatactaccaaaattaaaaagacccaagggctgggcatggtggttcacacctgtaatcccagcactttgggaggctgaggcaggcagattgcttgagctcaggagttcaagaccagcctgggcaacatagggagacccctgcctctacaaaaatacaaatgagccaggtgtggtagcccacacctgtggtcctagctacttggaaggctgaggcaggaggatcgcttgagcccaggagatccaggctgcagtaagccatgatcatgccactgcacttcagcctgggtgacagagactctgtttcaaaaaagggagggggggcaagtttttagggggatgagaaatattcttggtaaatcgggcatttctttttttgtttgtttttttttcttggagacagaatcttgctctgtcacccaggctggagtgcagtggcttgatctcagctcacggcaacctccgcctcccaagttcaagcgattctcccacctcagcctccagagtagctgggattacaggcaaccgccaccatgcccagctaatttttttgtatttttagcagagatggggtttcaccgtgttggccaggctggtctcaagctcctgatctcaaatgatccgcacgccttgacctcccaaagtgttgggattacaggcatgagccacagccttaattggtaatttttgaaaaaaaaactagagaaacattgtttcagagataaagcagcaattacacttgtactcccagtgatttaagatgcactattgtaatcaagatgatttgctttaatcaaaatattgttaaaaataggatttcaggacatttaaaaggtttcagcagaaatcttatgattatgtctgacttgcagtattttatttgcctctttgacggctttttttttttttttttttttgagacagagtctcacactgttgcctgggctggaatgcaatggcgcagtctcagctcactgcaaacctccggctcccgggttcaggcagttctcctgcctcagcctccctagtagctgggattataggcatgtgccaccacacccggctaatttttgtatttttagtagagacagggtttcgccatgttggtcaggctggtcttgaactcccaacctcaggtgatccgcccgcctcggcctcccaaagtgctgggattacaggcgtgagccactgcgcccaaccttaatggctttttggtattaaaaaccaggactctgaatgtgcatcaataattcaaataattttatatagttactctttctagtaatagatacccccctccatttttaagtaaagataaacattttttaattaggaaaattaggcacatttaattttagcaaatttagtttttcaacttttttttttttctttttttttttttttgagatggaggctcactctgttgccctggctggagtgcagtggccgcaacctcggctcactgcaacctccgcctcctgggttcaagtgattctcctgcctcagcctcccgagtagctgggattacaggcgtgtgccaccacacctggctaatttttgtatttttagtagagacggggtttcaccatgttggccaggctggtcttgaacgactggcctcaggtgatccgcccacctcggcctctcaaagtgctgggattacaggcatgagccaccatgcccagccagtttttcaacttttaaaaataaaagtggtagaatttttttttttctttttgagacagggtcttgctctgtcactcaggctagagtgcagtggtgggatctcagctcactgcagcctccgcctcccaggcttaagggatcctccctcctcagcctcccgagtagctgggaccacaggcatgcaccaccacgcctggctaatttttgtattttttgtagagatgggtgtctccccatgttgctcaggctgttcttgaacttctgagctcaggtgatctatctgcctcggccttccaaagtgctgggattacaggcatgatgagccactgcacctggccaaaagtggcagaaattttgatatggtttataatcagttttattgtggggaagatgggccattttaatgaatgattatttctattggctaaactaccgagtcacgacatgacaaatacacatgaagctttaatcacatgcagttatatacttctcacaaatcatcaaattatttatctggtcttcacactaagggatttacttagataagccatcgatgatttcagttgttaaaagtgtggctttttaaacagcatttattcagtgcatcctgatttatttcaaaatgaaaaattgttacctttttttctgaataaataaagcttacttttagtggcaa

SEQ ID NO: 187943 - DNA, 3264 bp, Homo sapiens
  Payload ID: 16984
  Gene Symbol: SYDE1
  Gene Name: synapse defective 1, Rho GTPase, homolog 1 (C. elegans)
  Uniprot ID: Q6ZW31
  ENST ID: ENST00000342784
  CDS Start-End: 32-2239
gcactcggctcggcccggcccgggccgcagcatggccgagccgctactcaggaaaaccttctcccgcctgcggggccgggagaaacttccccggaaaaagtcggacgccaaggagcgcggccacccagcccagcgcccagagcccagccctccagagccagagccccaggctcccgaagggtcccaggccggagcagaggggccctccagccccgaggcatcaaggagccctgcacggggagcctacctgcaaagcctggagcccagtagccgccgatgggtgctgggtggggccaagccagctgaggacacctctttagggcctggggtacctggcactggggagcccgccggcgagatctggtacaaccccatccctgaggaagaccccagacctccagcacctgagcccccggggccacagcctggctcagctgagtcagagggcctggccccccaaggtgcagcccccgccagccccccaaccaaagcctcccgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactgtttgtggggggcagcccctatcctgggttccagcatggacacaggggtagcctggggcttatagagaaacagctggtttcccctacccttttccggggaagtccccacgattggcctctagtcagcaaatggagataacagagtctggcctttccaatccccatctccttgccccccccttgcccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggttctgagactgagta

SEQ ID NO: 187944 - DNA, 3832 bp, Homo sapiens
  Payload ID: 16984
  Gene Symbol: SYDE1
  Gene Name: synapse defective 1, Rho GTPase, homolog 1 (C. elegans)
  ENST ID: ENST00000600252
  CDS Start-End: 1643-2821
ttttgggatgccagggactgagtagggggtgctctaagctgataactgagatcgctagcctgtggctgcctattccaaacaaaacagcaggatccaaggaaccatgacttatcaggggccggccagggccgtacacagcatcccacccactgatcaattgcacagggctgctctgcaggcagtgaggggctgggtgggtctcactccccttgctctctgccaggccacccagcccagcgcccagagcccagccctccagagccagagccccaggctcccgaagggtcccaggccggagcagaggggccctccagccccgaggcatcaaggagccctgcacggggagcctacctgcaaagcctggagcccagtagccgccgatgggtgctgggtggggccaagccagctgaggacacctctttagggcctggggtacctggcactggggagcccgccggcgagatctggtacaaccccatccctgaggaagaccccagacctccagcacctgagcccccggggccacagcctggctcagctgagtcagagggcctggccccccaaggtaagaacaagcttcccatccccttccccaaggtgagcaccagctccacatcccttcccttcagggtagcaccagcctcacactccctcctcccagaggagcaccaacctcacactccttcccttcaggggagcaccagcctcacatccccaccccgtcagatgctcccagaggagcatcagcctcacaccctcctccccgccaggggaacaccagcctcacactccttcccttcaggggagcaccagcctcacccccctcccctaagcccaggttcctggaccctgaagtctgctctccacacaggtgcagcccccgccagccccccaaccaaagcctcccgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgaggtaggacatgcggctgcaggggaggaggggcagggacccccaaaccccaccgccaccccccgcagagtgcctagggggctgggctccgggcggaaggtgtggcctggagcagcgaggccagggtacatgaagcttcagagcacacccggctcaggcccccttgtgtcctcagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactgtttgtggggggcagcccctatcctgggttccagcatggacacaggggtagcctggggcttatagagaaacagctggtttcccctacccttttccggggaagtccccacgattggcctctagtcagcaaatggagataacagagtctggcctttccaatccccatctccttgccccccccttgcccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggt

SEQ ID NO: 187945 - DNA, 3058 bp, Homo sapiens
  Payload ID: 16984
  Gene Symbol: SYDE1
  Gene Name: synapse defective 1, Rho GTPase, homolog 1 (C. elegans)
  Uniprot ID: Q6ZW31
  ENST ID: ENST00000600440
  CDS Start-End: 30-2036
actcggctcggcccggcccgggccgcagcatggccgagccgctactcaggaaaaccttctcccgcctgcggggccgggagaaacttccccggaaaaagtcggacgccaaggagcgcgggcctggggtacctggcactggggagcccgccggcgagatctggtacaaccccatccctgaggaagaccccagacctccagcacctgagcccccggggccacagcctggctcagctgagtcagagggcctggccccccaaggtgcagcccccgccagccccccaaccaaagcctcccgcaccaagtccccgggccccgccaggcgcctctccataaagatgaagaagctgccggaactgcggcgccgcctgagcctgcgaggcccccgggctggcagggagcgcgagagggctgcccctgcgggctccgtcatcagccgctaccacctggacagcagcgtggggggccccgggccggcagcagggcctgggggcacccggagcccgagggccggttacctcagcgacggggactcaccggagcgcccagctgggcccccatcacccacctccttccggccctacgaggtgggtcccgcagcccgggcacccccggccgcactctggggccgcctcagcctgcacctgtacggtctcggggggctgcggccagcgccgggggccacccccagggacctctgctgcctactgcaagtggatggggaggccagggcccgaacagggccactgcgaggggggccggacttcctgcggctggaccacaccttccacctggagctggaggccgccaggctcctgcgcgccctggtgcttgcgtgggaccctggcgtgagaaggcaccggccctgtgcccagggcaccgtgctgctgcccacggtcttccgagggtgccaggcccaacagctggccgtgcgcctggagcctcaggggctgctgtatgccaagctgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccacctctgcacctgccgctggcagaccccgaagtggtgactcggccccgcggtcgaggaggccccgaaagccccccgagcaaccgctacgccggcgactggagcgtttgcgggcgggacttcctgccctgtgggcgggatttcctgtccgggccagactacgaccacgtgacgggcagtgacagcgaggacgaggacgaggaggtcggcgagccgagggtcaccggtgacttcgaagacgacttcgatgcgcccttcaacccgcacctgaatctcaaagacttcgacgccctcatcctggatctggagagagagctctccaagcaaatcaacgtgtgcctctgagccagatgacggggtgggaccccggttagtaaggaccgggcgcccagtggctaaggcggtgccctggtgaccaaggagagccagacctgttgctcaggccgagctcctggttgccagcgagttaccacgggaccagtcgcgtgtatggctgagactcattcccagtttccagggcccggtatttggacactagttgccaagtctggggcctggggattttagggaccagcggttgtgaccatctttcctgagcaccaagggcttccccttttgttgccaaaaaggtagttctcgcgcttgctaggctggcctctcttgcctccccttggccggggcaacaccagttactgtgagcatcaccctggtgtggtgagtcacctctagtcggccctcttgctgctgccaaccaaatcagtattagctttgagcactgcactgtttctccctcccttggacgacacaaagactagcatgaggcactgtttgtggggggcagcccctatcctgggttccagcatggacacaggggtagcctggggcttatagagaaacagctggtttcccctacccttttccggggaagtccccacgattggcctctagtcagcaaatggagataacagagtctggcctttccaatccccatctccttgccccccccttgcccccccccccgaaaaaaattgagcacttaaacccctcccttttggagggggccccctgaagcgtcaggctgggggcagtctggtacggaacatatttattgcctccatgcatgtgtgtgtgtgtctgtgaggactggtgtgcgtggacacgtctgaagcaggcgtgtggggctctttcagggaccacagaggagggagcagtttgcagtgcccagccaccctgaaatccccaataatggtgcctcagtgggccccagagttccagtgggagagtacggttccctcctgtctccctcttcttttccgcacctccatctttgtggataataaataaatatgcacaggttctgagactga

SEQ ID NO: 187946 - DNA, 571 bp, Homo sapiens
  Payload ID: 16984
  Gene Symbol: SYDE1
  Gene Name: synapse defective 1, Rho GTPase, homolog 1 (C. elegans)
  ENST ID: ENST00000602203
  CDS Start-End: 1-571
tgaccctgtcggagcagcaggaagcccctgccacagctgagccccgcgtctttgggctgcccctgccactgctggtggagcgggagcggccccccggccaggtgcccctcatcatccagaagtgcgttgggcagatcgagcgccgagggctgcgggtagtgggactgtaccgtctttgtggctcagcggcagtgaagaaagagcttcgggatgcctttgagcgggacagtgcagcggtctgcctatctgaggacctgtaccccgatatcaatgtcatcactggccacgctgacgcttctcctggaccacctgcgcctcgtctcctccttccatgcctacaaccgcatgaccccacagaacttggccgtgtgcttcgggcctgtgctgctgccggcacgccaggcgcccacaaggcctcgtgcccgcagctccggcccaggccttgccagtgcagtggacttcaagcaccacatcgaggtgctgcactacctgctgcagtcttggccagatccccgcctgccccgacaatctccagatgtcgcgccttacttgcgacccaaacgacagccac

SEQ ID NO: 187947 - DNA, 539 bp, Homo sapiens
  Payload ID: 16984
  Gene Symbol: SYDE1
  Gene Name: synapse defective 1, Rho GTPase, homolog 1 (C. elegans)
  ENST ID: ENST00000597977
  CDS Start-End: 30-539
actcggctcggcccggcccgggccgcagcatggccgagccgctactcaggaaaaccttctcccgcctgcggggccgggagaaacttccccggaaaaagtcggacgccaaggagcgcggccacccagcccagcgcccagagcccagccctccagagccagagccccaggctcccgaagggtcccaggccggagcagaggggccctccagccccgaggcatcaaggagccctgcacggggagcctacctgcaaagcctggagcccagtagccgccgatgggtgctgggtggggccaagccagctgaggacacctctttagggcctggggtacctggcactggggagcccgccggcgagatctggtacaaccccatccctgaggaagaccccagacctccagcacctgagcccccggggccacagcctggctcagctgagtcagagggcctggccccccaaggtaagaacaagcttcccatccccttccccaaggtgagcaccagctccacatcccttcccttcagggtagcaccagcctca

SEQ ID NO: 187948 - DNA, 5512 bp, Homo sapiens
  Payload ID: 16985
  Gene Symbol: SYDE2
  Gene Name: synapse defective 1, Rho GTPase, homolog 2 (C. elegans)
  Uniprot ID: Q5VT97
  ENST ID: ENST00000341460
  CDS Start-End: 51-3635
gcaggctgcggacccagttgcgagaggcctattatctgctgatccaggccatgcacgacctgccccctgactcgggcgcgcggcggggcggcaggggcttggcggatcacagcttccccgcgggagcccgggctccgggccagccgccttcccgcggcgccgcgtaccgccgagcctgcccccgggacggggagcggggaggcggcggacgccctcggcagcaggtgtccccgccccggtcgcctcagagggagccgcggggaggccagctgcggactcctcggatgcggccgtcctgcagcagaagcctcgagagcctccgggtgggtgccaagccgcctcccttccagcggtggccgagcgacagctggatcaggtgcggcgcgcaccgggactgggacgagcccccgccacgtggaggcaggatggacggctggagtggggaccgcgcccgggcggctgcacccaccggcctccagcctccaggctgcaaggaccacggctgctcctcgggaagccctttcagggatccagcggggtcctctgtgatacgcagtggcaaaggagaccgccaggaaggcccctccttcctcaggccgccggcagtgacagtcaagaagctgcagaagtggatgtacaaagggcgtctgctgtccctgggaatgaagggtcgtgcccgtgggacggctcccaaagtcacaggaacgcaggcagcctccccaaatgtgggcgctttgaaagtgcgtgaaaaccgtgtcctgtcggtgcctccagaccaaagaattacgctgacagatttatttgaaaatgcctatgggtcttcaatgaagggaagagaacttgaagagctgaaggataatattgaattcagaggtcataagccacttaacagcatcactgtttcaaagaaacgcaattggctatatcagagtactctgaggcctcttaatctggaagaagaaaataagaaatgccaagatagaagtcatttatccatctcacctgtgtctctacctaaacatcagctatcacagtctttcctcaaatcatctaaagagtactgtacatatgtggtatgtaacgctacaaactcttcattatcgaaaaactgtgctttagattttaatgaggaaaatgatgcagatgatgaaggagaaatatggtacaatcccattcctgaggatgatgaccttggtatatcaagtgccttgagttttggtgaggccgactctgctgttctgaagctccctgctgtcaatttgagcatgttgtctggcagtgacctgatgaaagcagagcggcatactgaagactcactgtgctcttccgaacatgcaggtgatattcagaccacacggtcaaatggaatgaatcctatacatcctgcccattccacagaatttgtgcagcagtacaagcaaaagctaggacacaagacacaagaaggtataatggtggaggacagtcccatgttgaaatctccttttgcaggttctgggatcctggctgctacaaatagtactgaattgggaattatggaaccatcttctccaaatcctagccctgtgaaaaaaggcagttcaattaattggtcattgccagataaaataaaatctccacgaactgtgaggaaactttccatgaaaatgaaaaagttgccagaatttagccgaaagctaagcgttaagggaacattgaattatataaacagtccagataatactccttctttgtctaaatataactgccgagaagttcatcatactgatattctgccctctgggaacacaaccaccgctgctaagaggaatgttataagccgataccatcttgataccagtgtatcctcccagcagagctaccagaagaaaaactctatgagttctaagtattcctgcaaaggtggttaccttagtgatggagactcacctgaacttacaactaaagctagcaaacatggatctgaaaacaaatttggaaaaggaaaagaaataatttcaaatagttgtagcaagaatgaaatagacattgatgcttttaggcattatagcttttctgatcaacctaagtgttcacagtacatatctgggctcatgagtgtacatttctatggtgctgaggatttaaaaccacctcggatagattcaaaagacgtcttttgtgcaattcaggtagattcagtaaacaaagcaagaacagctttgctcacatgccgaacaacatttttagacatggatcacactttcaacatagaaattgaaaatgcacaacatttgaaactagtagtattcagttgggaacccactccaagaaaaaatcgagtttgttgtcatggaactgttgttcttcccaccttatttagagtgacaaagactcatcagttggctgtcaaacttgaacctagaggtcttatttatgtgaaagtgactcttatggaacagtgggagaattctcttcatggactagatataaaccaagaaccaataatatttggagttgatattcaaaaagttgtagagaaagaaaatataggactgatggtgccccttctgatacagaaatgtattatggaaattgaaaagagaggctgtcaggtagtaggcctgtatcgattatgtggttcggcagcagtcaagaaagaactgcgagaggcttttgagagagatagcaaagctgttggtctgtgtgaaaaccagtacccagatataaatgtaataacaggtgttcttaaggattatttaagagaactcccttctcctctgataacaaagcagctttatgaggctgtattagatgcaatggcaaaaagtcctttgaaaatgtcatcaaatggttgtgagaatgacccaggtgactctaagtacactgttgacctgctggattgtctgccagagattgagaaggcaaccctaaagatgttgttggatcatttgaaattggtggcttcctatcatgaagtgaataagatgacgtgccagaatttggctgtgtgctttggaccagtattattaagtcagaggcaagagccttccacccataacaacagagtctttactgattcagaagaacttgcaagtgctttggattttaaaaaacacattgaagttcttcattacttactccaactctggccagtgcagcgtttaactgtcaaaaaatcaacagacaatttattcccagagcagaagtcttctctgaattatctgaggcagaagaaagaacgacctcatatgttaaatttgagtggtactgattcatcaggagtacttaggccaaggcaaaaccgattagacagtccacttagcaatcgttatgcaggagactggagcagctgtggggaaaactactttttaaatacaaaagaaaatttaaatgatgtggattatgatgatgtcccttcagaagatagaaaaatcggagaaaattatagcaaaatggatgggccagaagtaatgattgaacagccaattcccatgtccaaagagtgtacatttcagacatatttgacaatgcagacagttgagtctacagtggatcgaaaaaacaatctcaaagatctacaagaaagtattgatactttgattggaaatctggaacgtgagctcaacaaaaacaagcttaatatgagtttttgagattgagggtttttttttgtaatgtcttaaagtttcaaatctgtttttgttttattttcttataccacccacagcgatgttttcatttttttactcttgaaatctttaattaatttttaataagtttatctgattcaattaaaaacactattcattaatacaatttttacttatctcactagaaaacttttctggggatcaataaaacttggacttcttgggatattttactaaatcttgccaactctatggagataactttcaaatgcacttaagaaggttcacataagttattagcccctcaaggtttttctgctttatgggaaccactcttctgtagctgagacagatgtccttttttttgttgttttttgagacagagtctcactctgtcgcccaggctggagtgcactggtgcgatctcaggtcactgcaacctccacctccctggttcaagtgattctcctgccacagcctcccgagtagctgtgatgacggggcccaccaccatgcccagctaattattgtatttttagtaaagatggggtttcaccatgttggccaggctggtctcgaactcctgatctcagatgatccgcccaccttggcctcccaaagtgctgggattacaggcgtgagccactgcgcctggcctctagatgttcttttagaggaacatcacagctgctcagtctgatttgcagtactggtcctggtacactgcaacatcctttggtcaaattttatttgtaatgcaaatgctgctataagaaaatctttttataaataaaagtgaaattatacaagtattaatgttttctgtattaacagtaattatttaagcttataaaaattaaatatttttataatcctgaaactgtatatatttataaatgcatatatgtatagatatcaggatgggggaggggttattgtagaatcacatgtatttttaaagtatatatgtcatgaggccaaaattattatcttaaagtatttttttcagggaaagaacatttaaattaaaggaggaattacataaaaacacttgaacaataatactctagaagcatctgaatagaaataatagactttctttcctttattcacagaaagtcacaatgtcccctgggaaaagtcatcttttaaatttgaaatcctctaactccttaagggattaagtacccagatttctgcactggtgacttagatttaataaatctgctcctgttctatgcatttttatattctgctttgttttaattatttatttgtagtagtacatttataacattgactttataattacccccatttgtttctaaatagtcttgccagcatattacatgttactgatttttaaaaattaacttattttggctaagtatatatacaatgttatagaatcacagtaatgtttgaaaatgtaaatttagaaggcttttgtattaaatcaaaatgtatttttttaacttttatatctacagaatatgtaattttaaaattataaatagactttaagttaccaacttttaagacatggcagccattgaaaaactggcttcctgatgtttttctaaatattaaagtacttaaaatatttctatgcaataaatattgataaacagacattatttaatttgaaaacccattgttaaaaaagataaatatttttatatgaaattttcattttttaaaactttgtgttaacaattcagaagaataccaagagaacatatatattgagtaaacagtcaaaggaaagtactcttgaatgttttataggaaagctgtctcagtttccttccttttgttgctatatcatgtatgaattgaataaattgctctagaaatgtaaaaattttattaaaatatta

SEQ ID NO: 187949 - DNA, 2522 bp, Homo sapiens
  Payload ID: 16986
  Gene Symbol: SYNDIG1
  Gene Name: synapse differentiation inducing 1
  Uniprot ID: Q9H7V2
  ENST ID: ENST00000376862
  CDS Start-End: 634-1410
agacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggagaaatggcttccctgaggcaagtgtaacctacattcccagcccaccagcctgacgcccagccagggagagagtaccatggatggcatcattgaacagaagagcatgctggtgcacagtaaaatcagtgatgctggcaagaggaatggtttaattaacaccagaaacttgatggccgagagcagagatggtctggtgtctgtttacccagcgccccagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggacggtgtggccgccgactgctgcgagaccaccttcatcgaggaccggtcgcccaccaaagacagcctcgagtacccggatgggaagttcattgacctctcagctgatgacataaaaatccacaccctgtcctacgatgtggaggaggaggaggagttccaggagctggagagcgactactcaagcgacacagagagtgaggacaatttcctcatgatgcccccgcgggaccacctgggcctcagtgtcttctccatgctctgctgcttctggcctctgggcatcgcagccttctacttgtcccatgagaccaacaaagccgtggccaagggggacttgcaccaggccagcaccagctcccggcgggccctattcctggcagtgctgtccatcaccattgggactggcgtctatgtgggcgtggccgtggccctcatcgcctacctctccaagaacaaccacctgtgagcttcctgcgaatggagggggagcacccggggccaggtctgtgtggacgtggaggaagcaggcataccgcatgatgctgtacagtacaaatgattgccaaatgatgccacgaagccctgggatttcctacccatggatttattttgtttttatcctttaatttcatgttcacagcactgtgtagagcaccagacagacgggcactgctaatccttccaaaggaaagctccaaagatcccagcccgcaaggctgtctctggatggattctggtggatgaatggcaacgcggctctctgcagcctgccagtgcccagagtgccaccgcattagcaatatacaaacagtccaaaaaagtgtttattttttatggaatacggtgcaataggcagaggacaagggacacatcactcttctgtctgtggccctgctggagtcctttgtgccccccggagtccacacgccttccctgcaagacgagaatggggctgggaagaaagaggcaacaccacggctggcaggagccccgctgcactgctctgcagacccattggcctgaccctgagaagcagagccagcaaagcccgggacctgcccctctttctttcccttcacaccaccccagcctcaggatgtcaagccacctccggaacgtgtctacactccacagctaccccgcagcaatacgcactcttgggacctcgctgatctaggatggggaggcaggccaccgcccctcccaagactcctcaagaaagagccccgcggttgctccggaaactcgaggcactgcagctatgggcactgcctcagcctaaagacacaggggcgcctcccaatcaccgcgctggcggatgctcaccccgtcataagcagaaactagtgatcctggaaatgagatgggccttactctgtcgactaaatgaatagctattttcttgtcattttttaaagtgcaactcttgcttcatgctgcttaagttaccagatgaatgctgagaaataagtaatcacagacattttaataccatttcattgctgttttacgagtgttcattacttaacaaaaaattatcttttagctttttcgcttaagacttttctttctgatgaa

SEQ ID NO: 187950 - DNA, 2607 bp, Homo sapiens
  Payload ID: 16987
  Gene Symbol: SYNDIG1L
  Gene Name: synapse differentiation inducing 1-like
  Uniprot ID: A6NDD5
  ENST ID: ENST00000331628
  CDS Start-End: 249-965
ggcggcggcgggctgcgggcgggagctgtccgcggtgctgaagcggcggctgctcagggacgcggggacgagagcaggggagccctcctgggagttccaccgcgaccgcgaggcgggggcgccgtcgctcaccggcccatgccgagcccccgagccccgcggaggaggcgggaccgtccgcggcgggacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaaggagcccagggcaggcagctgtgagacaagcttcacagaggacagggagccccaggaggggcctccagagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctgggacttactctcttctccatgctctgctgcttctggccactgggcattgctgccttctacttctcccaggggaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggttcttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaatagaattcatctaagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctggt

SEQ ID NO: 187951 - DNA, 2420 bp, Homo sapiens
  Payload ID: 16987
  Gene Symbol: SYNDIG1L
  Gene Name: synapse differentiation inducing 1-like
  Uniprot ID: A6NDD5
  ENST ID: ENST00000554823
  CDS Start-End: 63-779
gacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaaggagcccagggcaggcagctgtgagacaagcttcacagaggacagggagccccaggaggggcctccagagcagcccacaggacctggccaagctgcagagaatgtcaccatccagactgtgtcctatggggtacaagaggagctgcgggaccaggaggatgaccaggaggaagaggagagcgatgccacttcaacggagagtgaaagtgaagacaacttcctcacgctgcctcccagggaccacctgggacttactctcttctccatgctctgctgcttctggccactgggcattgctgccttctacttctcccaggggaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggttcttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaatagaattcatctaagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctgg

SEQ ID NO: 187952 - DNA, 488 bp, Homo sapiens
  Payload ID: 16987
  Gene Symbol: SYNDIG1L
  Gene Name: synapse differentiation inducing 1-like
  ENST ID: ENST00000554953
  CDS Start-End: 249-488
ggcggcggcgggctgcgggcgggagctgtccgcggtgctgaagcggcggctgctcagggacgcggggacgagagcaggggagccctcctgggagttccaccgcgaccgcgaggcgggggcgccgtcgctcaccggcccatgccgagcccccgagccccgcggaggaggcgggaccgtccgcggcgggacaggctctgaggactgctcagctggcccaggcccccctccccagcagctgccccagaaccatggagagtctgagtgaactacagaacccgctgctgcccaggagccctgcccatctccatggcccctatccctacccggagaccccacccagctggtcctgccaggaaaagctctactcctacctcctaggtggcgctgggcctgccggagcccaccagctcctggacccagggtccctgcagctggccgtggaggcctggtaccggcccagctgcctcctggggagagacaaggtcaag

SEQ ID NO: 187953 - DNA, 3209 bp, Homo sapiens
  Payload ID: 16988
  Gene Symbol: SYN1
  Gene Name: synapsin I
  Uniprot ID: P17600
  ENST ID: ENST00000295987
  CDS Start-End: 126-2243
tgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatgctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggcccagcagaa

SEQ ID NO: 187954 - DNA, 3165 bp, Homo sapiens
  Payload ID: 16988
  Gene Symbol: SYN1
  Gene Name: synapsin I
  Uniprot ID: P17600
  ENST ID: ENST00000340666
  CDS Start-End: 126-2135
tgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatgctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttagccaggacgaggtgaaagctgagaccatccgcagcctgaggaagtctttcgccagcctcttctccgactgataccccactctgagaaccccaaaatccctgggcaacccttctctgggccctgaatccatttctcacttttggagtctccaaatcccttgagaacccatctcccggttctccaagattccacctctcattcctcaagatccccgagtaccttgagaaacctgactcctcctggccctaaatccggttctcacatgtggaatccccaagtccttttagaaccccactcgtggtcacttcaggatctacttctgttttagaacctccacattcctgaagacctccgcccctggtttccccagagggcgttttccttcctggaagtgcccaaataccaggcaacccattgcagaatcccttcctggagccctgaagttcctggaaaaccctatttttggtcccaaatctctccagcacacctatttcccatcataattttccaaatcctcaagaaacccctactgttgagccccttcccatggatcttccatccctctgaagatccacatcttcaaatgccacccaacacctagccccacaaggatttcccttcaccagctcccctcaacctcattcaataccttgggagcccctcccacttccaggacccctcggttcccccagggaccccctccccagtttcctgcctctgacagctgtctttaaatatgcaaactccacccatcttcccagaatcctttgcacacggaaggccagtggtctccgcttccccacctttgctgtggtgtctgtgtctgtgactgacgtggcctccttttgtgccgtgcttggcatatgtggtcctcgttcatcgtgccgcctgtggtgatgcgtgcagtgacgctgtttatgtggtccgcacctccccctgaccttcactccttgcctggactcaccccacccctcagcggctctgaaccccaagagaagagtcgggaaacaaaataaacaagcaaaggccca

SEQ ID NO: 187955 - DNA, 2356 bp, Homo sapiens
  Payload ID: 16989
  Gene Symbol: SYN2
  Gene Name: synapsin II
  ENST ID: ENST00000425297
  CDS Start-End: 1-664
gctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagt

SEQ ID NO: 187956 - DNA, 2674 bp, Homo sapiens
  Payload ID: 16989
  Gene Symbol: SYN2
  Gene Name: synapsin II
  ENST ID: ENST00000621198
  CDS Start-End: 151-1899
gtctgcggggtctggtgccggggcctgagtctctgctggctaagccgccgcctcagccgcctcagtcgcctcaatctcgccttccgccctcgctctccctccgcgccaccagaccccgtagccccgcgcgcccccagccctttaagccagatgatgaacttcctgcggcgccggctgtcggacagcagcttcatcgccaacctgcccaacggctacatgaccgacctgcagcggcccgagccccagcagccgccgccgccgccgccccccggtccgggcgccgcctcggcctcggcggcgcccccgaccgcctcgccgggcccggagcggaggccgccgcccgcctcggcgcccgcgccgcagcccgcgccgacgccgtcggtgggcagcagcttcttcagctcgctgtcccaagccgtgaagcagacggccgcctcggctggcctggtggacgcgcccgctcccgcgcccgcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaagggggccctgggcaaccccaaggaatgcagcccccaggcaaggtgctgcctccacgccggctcccccctggaccatcactgccaccttcctcctcttcctcctcttcttcctcctcctcggctcctcagcggccgggcggccccaccacccacggagatgcaccctccagcagcagctccctggcagaggcccagccacccctggctgctccaccacagaagccccagcctcacccacagctcaacaagtcgcagtccctgacaaatgccttcagcttctctgagtcctccttcttccggtcttcagccaatgaggatgaagccaaagcagagaccatccggagcttgaggaagtcctttgccagcctcttttcagattagctcttcagacacacggggcacccagcccaaccgggaaaggcatctaagacattcaccaacaacagtcagccagcttggtggttatgtcccatgaccttgacgtgtgtggtcccttcctctgctctgttgtactaagtgatgttgtgcagcccagaaaggaccatttgacagtctcagggcaggtgcctacccagcaaggggtacctggcatcagagaggaaagagctgcttccctgtagtcatgagagcttccttctgaagtcatcgttcgctgtgagtttagtggccttattgtgacagtgccatcatgtcttattcttccctgtgaaaccaggattaatcgtggactcctggcagcttaacctagctcagttgcagtgctaagcatgccccgcccccattcagtgatacctgtttgggaagtatatacttccccaaaagtactcttggccctaagttttaggaactttccccgacctggatcccttgtcatacctgtgttactgtttaaagcacacccacccaacttacaagatcttaggctgctgtggtggtgaagcaccttgagtctgctgatattcgggagaacaaggatctgcagtttccccttttctcccctctgaagagtggttcttatgtgcaatctgcagtaaccttgaactccagagctgcactatagaggagaatgcatgccactatgacagcagtatgccaagctttgtgttcatctcctaataaacgttaagacctttggtgtaataaaagcagcagcatt

SEQ ID NO: 187957 - DNA, 3871 bp, Homo sapiens
  Payload ID: 16989
  Gene Symbol: SYN2
  Gene Name: synapsin II
  ENST ID: ENST00000620175
  CDS Start-End: 147-1583
gcggggtctggtgccggggcctgagtctctgctggctaagccgccgcctcagccgcctcagtcgcctcaatctcgccttccgccctcgctctccctccgcgccaccagaccccgtagccccgcgcgcccccagccctttaagccagatgatgaacttcctgcggcgccggctgtcggacagcagcttcatcgccaacctgcccaacggctacatgaccgacctgcagcggcccgagccccagcagccgccgccgccgccgccccccggtccgggcgccgcctcggcctcggcggcgcccccgaccgcctcgccgggcccggagcggaggccgccgcccgcctcggcgcccgcgccgcagcccgcgccgacgccgtcggtgggcagcagcttcttcagctcgctgtcccaagccgtgaagcagacggccgcctcggctggcctggtggacgcgcccgctcccgcgcccgcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgatgagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctgtc

SEQ ID NO: 187958 - DNA, 972 bp, Homo sapiens
  Payload ID: 16990
  Gene Symbol: SYN3
  Gene Name: synapsin III
  ENST ID: ENST00000332840
  CDS Start-End: 1-972
cagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaa

SEQ ID NO: 187959 - DNA, 3126 bp, Homo sapiens
  Payload ID: 16990
  Gene Symbol: SYN3
  Gene Name: synapsin III
  Uniprot ID: O14994
  ENST ID: ENST00000358763
  CDS Start-End: 244-1986
gctcccgggacccggagcggatcgactggcgggcgccgcgccgaggcaccaccgggcgccgagttcctggcggctcgcacgcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcaggctgaattctcagagttgaacctagctgcctatgtgaccgggggctgcatggtggacatgcaggtcgtgagaaatgggaccaaagtggtgagcagatccttcaagccagacttcatcctggtccgccagcatgcctacagcatggccctgggggaagactaccgcagcctggtcatcggcctgcagtatggagggctgcctgctgtcaactctctctactccgtctacaacttctgcagcaagccctgggtgttctctcagctcattaagatcttccattccctgggtcctgagaagttcccgcttgtggagcaaacatttttccccaaccataagccaatggtcacagccccacacttcccggtggtagtcaagctgggacatgcccacgctggaatgggaaagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaacaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagtggggtctttcagaacacgacagaaacaggggggcccttgtaatgccactcatactcagagcattattcttatttggacagccaagggcagatcacaggttattgtaggaataaagactagtttacaaaggagaaagaggccctggacttcccaaggaaagggtcaggttagggctcctgtacccattctgttccaccactgtttgatctctctggcctcccaccaggaatgccgtttcctttttatggatctgttgggaaccagagagaatcaacagatcaatgacataggatccgaagtgcaatgatagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatccaaa

SEQ ID NO: 187960 - DNA, 632 bp, Homo sapiens
  Payload ID: 16990
  Gene Symbol: SYN3
  Gene Name: synapsin III
  ENST ID: ENST00000412575
  CDS Start-End: 292-632
ggattacaggcgtgagccaccctgtccggcgggaatgtaaattaatacggccattatggaaaacggcatggaggttcctcagaaaactaaaaatagaactaccatatgatccagcaggctcacttctggcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaa

SEQ ID NO: 187961 - DNA, 855 bp, Homo sapiens
  Payload ID: 16990
  Gene Symbol: SYN3
  Gene Name: synapsin III
  ENST ID: ENST00000441821
  CDS Start-End: 487-855
ttgggtttgggaggtcaggtttgtcatgccatttccgatttccagtcatcctgggggcaggatgaaatttcagagtggtttcctggccaagctagaagcagagaatagctatggatacagcacctcgtgtatctatccagcacttacttggctttttctgagtgccaggaactgtgccaagccctagcagcatgaagaatggcctttggggagcttctggggctaagagggacagtaggaggagcaattgcagtgcagggtagtgcggaagactcgagatggagaagaggacggtgaggaagccaggaaggtttcagagaggagcaggtaaataaaggcagctaaagctgactgctggttgcgcaaaatccccctggctcttctggctaaagtcctaccactccctgtacctggcagcagcctgtcttctgggcctcacctacacacgtctgggtaggagccagtcatctccatccatccacagccatgaatttcctccggcgacgtctctctgacagcagcttcatggccaacctgcctaatggctatatgacggacctgcaacgcccagatagctccaccagctcacctgcttcccccgccatggagaggaggcacccccagcccctggctgcctccttctcctctccaggatccagcctttttagctccctctccagtgccatgaagcaggcccctcaggccacctcaggactgatggagcctccaggtccctccacgcccattgttcaaagacccaggatcctgttggtgatcgatgatgcccatacagactggtcgaagtatttccatgggaagaaggtgaatggagagattgagatccgagtggagcag

SEQ ID NO: 187962 - DNA, 561 bp, Homo sapiens
  Payload ID: 16990
  Gene Symbol: SYN3
  Gene Name: synapsin III
  ENST ID: ENST00000619146
  CDS Start-End: 1-561
cagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgagaacctccatctctgggaactggaaggccaacacaggctctgccatgctggagcaggtggccatgacagagaggtacaggctgtgggtggacagctgctcggaaatgtttggcggcctggacatctgtgccgtcaaggctgtccacagcaaggatggcagagattacatcatcgaggtaatggacagctcaatgccgctgattggagagcatgtggaagaggacagacagctgatggccgaccttgttgtctccaaaatgagccagctcccgatgccaggaggcacagcgccctcccccctcagaccttgggctccacagattaaatcagcgaaatccccagggcaagcccagctggggcctcagctaggccagccccagccacgcccacctccgcaagggaatgtcccacct

SEQ ID NO: 187963 - DNA, 4556 bp, Homo sapiens
  Payload ID: 16991
  Gene Symbol: SYNGAP1
  Gene Name: synaptic Ras GTPase activating protein 1
  ENST ID: ENST00000293748
  CDS Start-End: 1-3855
atgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaattctcctggttccgctttggccacgggcggaggacacagggggaggtgactccggaccactgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccggg

SEQ ID NO: 187964 - DNA, 1461 bp, Homo sapiens
  Payload ID: 16991
  Gene Symbol: SYNGAP1
  Gene Name: synaptic Ras GTPase activating protein 1
  ENST ID: ENST00000355818
  CDS Start-End: 1-1461
gaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccaca

SEQ ID NO: 187965 - DNA, 4601 bp, Homo sapiens
  Payload ID: 16991
  Gene Symbol: SYNGAP1
  Gene Name: synaptic Ras GTPase activating protein 1
  Uniprot ID: Q96PV0
  ENST ID: ENST00000395071
  CDS Start-End: 1-3900
atgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaattctcctggttccgctttggccacgggcggaggacacagggggaggtgactccggaccactgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccggg

SEQ ID NO: 187966 - DNA, 5828 bp, Homo sapiens
  Payload ID: 16991
  Gene Symbol: SYNGAP1
  Gene Name: synaptic Ras GTPase activating protein 1
  Uniprot ID: Q96PV0
  ENST ID: ENST00000418600
  CDS Start-End: 1-3858
atgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcagcccgtcccttcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 187967 - DNA, 4339 bp, Homo sapiens
  Payload ID: 16991
  Gene Symbol: SYNGAP1
  Gene Name: synaptic Ras GTPase activating protein 1
  Uniprot ID: Q96PV0
  ENST ID: ENST00000414753
  CDS Start-End: 181-4035
gggggaagaggaaagcctgcctatgggcaatgacctttaacccatctttccccccagctagccccttctggggtgggtgggcaccagggacctagcctccctggatctttggtgtccttcattactggggttttactgaccctctcagtcatgctcccctgctgactgccagccccagtcatgggcctaaggcctcccaccccatccccctcagggggctcctgctcaggttccttgccccctccttcccgctgccagcctctccgccgtcgctgctcttcctgctgctttccgggggaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcct

SEQ ID NO: 187968 - DNA, 4339 bp, Homo sapiens
  Payload ID: 16991
  Gene Symbol: SYNGAP1
  Gene Name: synaptic Ras GTPase activating protein 1
  Uniprot ID: Q96PV0
  ENST ID: ENST00000428982
  CDS Start-End: 181-4035
gggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccgggggaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcct

SEQ ID NO: 187969 - DNA, 5916 bp, Homo sapiens
  Payload ID: 16991
  Gene Symbol: SYNGAP1
  Gene Name: synaptic Ras GTPase activating protein 1
  Uniprot ID: Q96PV0
  ENST ID: ENST00000455687
  CDS Start-End: 102-4133
cctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 187970 - DNA, 3930 bp, Homo sapiens
  Payload ID: 16991
  Gene Symbol: SYNGAP1
  Gene Name: synaptic Ras GTPase activating protein 1
  ENST ID: ENST00000449372
  CDS Start-End: 11-3930
cccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagcccc

SEQ ID NO: 187971 - DNA, 4264 bp, Homo sapiens
  Payload ID: 16991
  Gene Symbol: SYNGAP1
  Gene Name: synaptic Ras GTPase activating protein 1
  Uniprot ID: Q96PV0
  ENST ID: ENST00000628646
  CDS Start-End: 1-3900
atgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctcta

SEQ ID NO: 187972 - DNA, 9862 bp, Homo sapiens
  Payload ID: 16991
  Gene Symbol: SYNGAP1
  Gene Name: synaptic Ras GTPase activating protein 1
  Uniprot ID: Q96PV0
  ENST ID: ENST00000629380
  CDS Start-End: 196-4227
tctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagaggaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttctgggcaggtgaaggcaggctggtggctgaaggacctccttcttatcttccacaggggctggaagttaaaacccctgttggtgtttagtggtggtggttgttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtctctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacct

SEQ ID NO: 187973 - DNA, 2903 bp, Homo sapiens
  Payload ID: 16992
  Gene Symbol: SV2A
  Gene Name: synaptic vesicle glycoprotein 2A
  Uniprot ID: Q7L0J3
  ENST ID: ENST00000369145
  CDS Start-End: 451-2499
ttgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccacagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggtagttggaatgtgttggaggcagggcagtggattcaggggaggggtggggtgaggaaggagggctgaatgggaagagcatccttaggggtgagaggatatacatttccattttctcctctaaaatctggtagctttggccgggcacggtgactcatgcctgtaatcccagtgctttgggaggccgaggcaggcagatcacctgaggtcaggagtttgagaccagcctggccaacatggtgaaaccctgtctgtactaaaaatacaaaaagttagctgggtgcctgtaatcgcagctactcaggaggctaaggcaggagaattgcttgaacccgggaggtggagctttcagtgagccgagatcgcaccactgcactccagcctgggcaacagagcaagactccgtctc

SEQ ID NO: 187974 - DNA, 4416 bp, Homo sapiens
  Payload ID: 16992
  Gene Symbol: SV2A
  Gene Name: synaptic vesicle glycoprotein 2A
  Uniprot ID: Q7L0J3
  ENST ID: ENST00000369146
  CDS Start-End: 492-2720
aggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccacagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaatacaaaa

SEQ ID NO: 187975 - DNA, 11202 bp, Homo sapiens
  Payload ID: 16993
  Gene Symbol: SV2B
  Gene Name: synaptic vesicle glycoprotein 2B
  Uniprot ID: Q7L1I2
  ENST ID: ENST00000330276
  CDS Start-End: 395-2446
cagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtctgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaaggactggggttagagattattttcaggcactaaggtctcttctgtattccaaaattgattgaatcagctgggagaaacattgagaatcgcttccttcaacttttattttgcaacatggggaccttgagaggttaaacgatgtggcccagattacatgtaatgtgaggagtgggcgagaaggcctaaggtgatgctctcatgacagttctggggaagcctgcagtttggggaatgggacaatgtgacaaatactcgccattccctgagaccattcattgactattcccttgatggctttactataatgagaggaagcatcagtttaaacataaaaagattagtatttatccatccatttattcattcagcaaatccttattgagccctgaccatgggccagtctctctgccaagccctggggacacagtgatgaaaaaactggccacagtttctgcttcctgcctcattccacttgcagtgagcggatattaaattggccataaacaccgagtacgatgaccttacaatccgcaaactgcacctttcatgtgtaaaaggattgctactactttacttgtcagctgtggatttccaaatgtggtggctccctcttatttttttttctttgaggagtgtaccaattttttatctttataaaccaggtaagggaaatgatgcccttgcccattttctacagacctaatcgatttttacctaatcagttttacagaaagggttacatggaagaagagataggggccaggaatgcaagagggacattggtgagtggggtaagaatccccgtagccctgggaaaggtgtctccacttccacatctggcttttctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgttccttctgcctgatcgttgggagcacactccttctgcctgatcatgggagcacactccttctgcctgatcattgggagcacgctccttctgcctgatcgttgggagcacactctttctgcctgatcgttgggagcacaccccttctgcctgatcattgggagcacactccttctgcctgatcatgggcacacgctccttctgcccgatcatgggcacacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaattacagaatgagcaagagatttatttagcaggaccatactatgccccctggaaggttcagtttatgagctggagcacaaggatttactgtcatttcacctgaaaacacacatttagctgtccatttacctttaatcctacaggcttaaaatactttaaaatttcagagaccattaatatgtattcctttagaaagcaaaggtctttcagaagctgtcctctaccaaagttaatgtggtcaccacatttgatgattttgctaggtagggaggtttatttaatcacagctactgtcactcaggaggatgagccatttaaaaatggtggccctgtcctccacttcttacctaccatatataatctcagtaattcagatttctctaaatcagcattagtgatcatttcaatagggtatgaacaaaaggcctataaaaatagctttccaattcgccaccaaaaatgcaaaaatgacaagtaagtgaggtaacgcatgagctaaatagcttgatttagtcactctaaaatgtgggtgtgtatatatacatacatatatatacacacacacattatgttatacaccataaatatatagaagttttacttgtcaattaaaactataaataaagtggctttccagaaaaattagatattggactctatcacaaaggaattgcataaaaatacttacaaacataactataagcaattgatgagcaaattacaaatgactgttttttattaaaacattcctccaaaagaacggcaaagcaaatcccatagacacccaaaatactaaaagtgacaaaacaatacttctttaaaaatgtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaaccc

SEQ ID NO: 187976 - DNA, 11279 bp, Homo sapiens
  Payload ID: 16993
  Gene Symbol: SV2B
  Gene Name: synaptic vesicle glycoprotein 2B
  Uniprot ID: Q7L1I2
  ENST ID: ENST00000394232
  CDS Start-End: 471-2522
ggagctgcacgcggggctgccggggcggacgctgctctgcctgcatccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtctgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaaggactggggttagagattattttcaggcactaaggtctcttctgtattccaaaattgattgaatcagctgggagaaacattgagaatcgcttccttcaacttttattttgcaacatggggaccttgagaggttaaacgatgtggcccagattacatgtaatgtgaggagtgggcgagaaggcctaaggtgatgctctcatgacagttctggggaagcctgcagtttggggaatgggacaatgtgacaaatactcgccattccctgagaccattcattgactattcccttgatggctttactataatgagaggaagcatcagtttaaacataaaaagattagtatttatccatccatttattcattcagcaaatccttattgagccctgaccatgggccagtctctctgccaagccctggggacacagtgatgaaaaaactggccacagtttctgcttcctgcctcattccacttgcagtgagcggatattaaattggccataaacaccgagtacgatgaccttacaatccgcaaactgcacctttcatgtgtaaaaggattgctactactttacttgtcagctgtggatttccaaatgtggtggctccctcttatttttttttctttgaggagtgtaccaattttttatctttataaaccaggtaagggaaatgatgcccttgcccattttctacagacctaatcgatttttacctaatcagttttacagaaagggttacatggaagaagagataggggccaggaatgcaagagggacattggtgagtggggtaagaatccccgtagccctgggaaaggtgtctccacttccacatctggcttttctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgttccttctgcctgatcgttgggagcacactccttctgcctgatcatgggagcacactccttctgcctgatcattgggagcacgctccttctgcctgatcgttgggagcacactctttctgcctgatcgttgggagcacaccccttctgcctgatcattgggagcacactccttctgcctgatcatgggcacacgctccttctgcccgatcatgggcacacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaattacagaatgagcaagagatttatttagcaggaccatactatgccccctggaaggttcagtttatgagctggagcacaaggatttactgtcatttcacctgaaaacacacatttagctgtccatttacctttaatcctacaggcttaaaatactttaaaatttcagagaccattaatatgtattcctttagaaagcaaaggtctttcagaagctgtcctctaccaaagttaatgtggtcaccacatttgatgattttgctaggtagggaggtttatttaatcacagctactgtcactcaggaggatgagccatttaaaaatggtggccctgtcctccacttcttacctaccatatataatctcagtaattcagatttctctaaatcagcattagtgatcatttcaatagggtatgaacaaaaggcctataaaaatagctttccaattcgccaccaaaaatgcaaaaatgacaagtaagtgaggtaacgcatgagctaaatagcttgatttagtcactctaaaatgtgggtgtgtatatatacatacatatatatacacacacacattatgttatacaccataaatatatagaagttttacttgtcaattaaaactataaataaagtggctttccagaaaaattagatattggactctatcacaaaggaattgcataaaaatacttacaaacataactataagcaattgatgagcaaattacaaatgactgttttttattaaaacattcctccaaaagaacggcaaagcaaatcccatagacacccaaaatactaaaagtgacaaaacaatacttctttaaaaatgtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaaccca

SEQ ID NO: 187977 - DNA, 2099 bp, Homo sapiens
  Payload ID: 16993
  Gene Symbol: SV2B
  Gene Name: synaptic vesicle glycoprotein 2B
  Uniprot ID: Q7L1I2
  ENST ID: ENST00000545111
  CDS Start-End: 417-2015
atatttattggtctgcaaatccggagaccttgcggcctcactggtcctccttccctctgagctatctccacacccagccttcgatcagaaggagatttagaagcagagctgcccgcagcgaatacttttaatgcccgggccgggaagaaagcgggttaggatctgatcccgctgagtagaggacccaggagcctcccgccccgcgtgctctgtagcgcgggggcgcgctgcgcgctgcgcctgggcggctggcgggggcggcgtgggcgcggtgatgcaggtgtgacacccgccggcgcctgcctccgcccggatcgcccagctccgcgttagccggagctgcacgcggggctgccggggcggacgctgctctgcctgcatccggaggcggccgccagcggatttgccacccagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccgg

SEQ ID NO: 187978 - DNA, 4077 bp, Homo sapiens
  Payload ID: 16993
  Gene Symbol: SV2B
  Gene Name: synaptic vesicle glycoprotein 2B
  Uniprot ID: Q7L1I2
  ENST ID: ENST00000557410
  CDS Start-End: 529-2580
gctgctctgcctgcatccggaggcggccgccagcggatttgccacccaggtcctaagactctcagtccagagagggccctgccccacacccagaaggaaggaatgctgcccagagatgaccagaggaatctagacagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaaga

SEQ ID NO: 187979 - DNA, 3010 bp, Homo sapiens
  Payload ID: 16994
  Gene Symbol: SV2C
  Gene Name: synaptic vesicle glycoprotein 2C
  ENST ID: ENST00000322285
  CDS Start-End: 201-2231
gacggaggcagcccggggaagcgagccggagcggcgcccgcactgaggcggctgcagtgctgacaccactcagggcaagggtgtccgacggctggagcgttctgttttgaacccaaagtggatgatgctgtcagagctgaaccactgaaaggaggctgtgaaaatttcccatcttctcattggccatcagttgagataagatggaagactcttacaaggataggacttcactgatgaagggtgccaaggacattgccagagaggtgaagaaacaaacagtaaagaaggtgaatcaagctgtggaccgagcccaggatgaatacacccagaggtcctacagtcggttccaagatgaagaagatgatgatgactactacccggctggagaaacctataatggtgaggccaacgatgacgaaggctcaagtgaagccactgaggggcatgatgaagatgatgagatctatgagggggagtatcagggcatccccagtatgaaccaagcgaaggacagcatcgtgtcagtggggcagcccaagggcgatgagtacaaggaccggcgggagctggaatcagaaaggagagctgacgaggaagagttagcccagcagtatgagctgataatccaagaatgcggtcatggtcgttttcagtgggcccttttcttcgtcctgggcatggctcttatggcagacggtgtagaggtgtttgtcgttggcttcgtgttacccagtgctgagacagacctctgcatcccaaattcaggatctggatggctaggcagcatagtgtacctcgggatgatggtgggggcgttcttctggggaggactggcagacaaagtgggaaggaaacagtctcttctgatttgcatgtctgtcaacggattctttgccttcctttcttcatttgtccaaggttatggcttctttctcttctgtcgcttactttctggattcgggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcaccgagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcactattaactttacaatggaaaatcagattcatactggaatggaatacgacaatggcagattcataggggtcaagttcaaatctgtaactttcaaagactctgtttttaagtcctgcacctttgaggatgtaacttcagtgaacacctacttcaagaactgcacatttattgacactgtttttgacaacacagattttgagccatataaattcattgacagtgaatttaaaaactgctcgttttttcacaacaagacgggatgtcagattacctttgatgatgactatagtgcctactggatttattttgtcaactttctggggacattggcagtattgccagggaacattgtgtctgctctgctgatggacagaattgggcgcttaacaatgctaggtggctctatggtgctttcggggatcagctgtttcttcctttggttcggcaccagtgaatccatgatgataggcatgctgtgtctgtacaatggattgaccatctcagcctggaactctcttgacgtggtcactgtggaactgtaccccacagaccggagacgcagagtcttgccatgttgccccggctgatcttgaactcctggcctcaagcaatcctcctgcctcagcctcccaaagttctgggattacagtctcgagccactgcacctggctttctttccatttttgaggattaaaattacttgaaattttccaaatatattatacaaggtcttgctaagaacttagtagatttctttattgttgtcttttttctctctcttttgccttgtagaaatatcccacaaagtgaagtaaccaagtcaacaagtgtgaacaattttatagctctccttaaatttactatacagctctcagaaacaacggagccagtttatagcaggagccattagtgggtgtggacctcttttctaagatctgcttctaaacttggctttatcacataaagagagaaaagcattacaaacaatttgaaggaattctttgtcttataaaaaaaattctgaaaacctccttgtattcccactaggaggtatagttaaccttgcaactccacaaacagaccactttacacacttgcccaggggcctttgtttttgcttgcccctcctctgaaatgctctctacaggtgattaagtggcttttccctttacttaggtgtctactcaggtaaaatcttaaccaagacgcctttacttaaaatgtccctctgccccaccctgaggcttttaacttgcatagccctcatcatcacctgacataatatgtacttctttgcttttatagatattatctgtgtccctccactaggatgtccatttcatgggaataaagactttgtctcttt

SEQ ID NO: 187980 - DNA, 11035 bp, Homo sapiens
  Payload ID: 16994
  Gene Symbol: SV2C
  Gene Name: synaptic vesicle glycoprotein 2C
  Uniprot ID: Q496J9
  ENST ID: ENST00000502798
  CDS Start-End: 443-2626
gacttgccggagcaccgcgagtggcgcgcgggtcccgcctcccccgcgcgccgtgactccctgcgcaccgctggtactctcgccacgccgccgcccggcactgcagcaccagggggaggaggcaggcggaggagaggaggaggaccgcagcgtgcaagccgggagccactttcccgcccctcctctcgccgctgacacgctcagaggagtcaccactccgcgcgctgcaggcgagagtggcagacggaggcagcccggggaagcgagccggagcggcgcccgcactgaggcggctgcagtgctgacaccactcagggcaagggtgtccgacggctggagcgttctgttttgaacccaaagtggatgatgctgtcagagctgaaccactgaaaggaggctgtgaaaatttcccatcttctcattggccatcagttgagataagatggaagactcttacaaggataggacttcactgatgaagggtgccaaggacattgccagagaggtgaagaaacaaacagtaaagaaggtgaatcaagctgtggaccgagcccaggatgaatacacccagaggtcctacagtcggttccaagatgaagaagatgatgatgactactacccggctggagaaacctataatggtgaggccaacgatgacgaaggctcaagtgaagccactgaggggcatgatgaagatgatgagatctatgagggggagtatcagggcatccccagtatgaaccaagcgaaggacagcatcgtgtcagtggggcagcccaagggcgatgagtacaaggaccggcgggagctggaatcagaaaggagagctgacgaggaagagttagcccagcagtatgagctgataatccaagaatgcggtcatggtcgttttcagtgggcccttttcttcgtcctgggcatggctcttatggcagacggtgtagaggtgtttgtcgttggcttcgtgttacccagtgctgagacagacctctgcatcccaaattcaggatctggatggctaggcagcatagtgtacctcgggatgatggtgggggcgttcttctggggaggactggcagacaaagtgggaaggaaacagtctcttctgatttgcatgtctgtcaacggattctttgccttcctttcttcatttgtccaaggttatggcttctttctcttctgtcgcttactttctggattcgggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcaccgagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcactattaactttacaatggaaaatcagattcatactggaatggaatacgacaatggcagattcataggggtcaagttcaaatctgtaactttcaaagactctgtttttaagtcctgcacctttgaggatgtaacttcagtgaacacctacttcaagaactgcacatttattgacactgtttttgacaacacagattttgagccatataaattcattgacagtgaatttaaaaactgctcgttttttcacaacaagacgggatgtcagattacctttgatgatgactatagtgcctactggatttattttgtcaactttctggggacattggcagtattgccagggaacattgtgtctgctctgctgatggacagaattgggcgcttaacaatgctaggtggctctatggtgctttcggggatcagctgtttcttcctttggttcggcaccagtgaatccatgatgataggcatgctgtgtctgtacaatggattgaccatctcagcctggaactctcttgacgtggtcactgtggaactgtaccccacagaccggagggcaacaggctttggcttcttaaatgcgctatgcaaggcagcagccgtcctgggaaacttaatatttggctctctggtcagcatcaccaaatcaatccccatcctgctggcttctactgtgctcgtgtgtggaggactcgttgggctgtgcctgcctgacacacgaacccaggttctgatgtaatgggaaaaaaagccatccttcctgcgtttcttcctcctgccctgggtcaattctccttcctgactcaaggcttcagagttttcctatatagaaaggtgatcaagtatcagaacataaacacgtgctgtgacttaaaatttagaagcatatcatcttgcccctttgtgattttgcacaggttgtttgtttgttttgttttgtttgaatgcattgttatctttccaaactgtgatgctactgcctcccgcaaatcagtggaagcatttctaaaatgccctaggcagccaggcttccctggggttctgctcattgaaagtttagaagctaagaagactgggctggtgtaagaaatagatcctgctcctaatttaacattaacaggaaatataagtcggcacattattgcatttgtgctgagaagagggattctttttttttttttttctaacagagtgatatttcctgtttacttagaaaaggacacccagtaattctcactgttatagcagagcctttcaaagaaaaccatgtggcaccaaacagggctgggtggggctctttggggcaagacaattaaggtgaccgctgacaagaaaaataaaagctctgcaattagcagcaaaaatctgagtgtgctgcataagcaagatttctgtcagaaagcccaattaaacctctgaaaagtgtgaggaaaaagaactgtaacagtatctgtgactgtggcatgtggttcagaatgtttgaaaatcagagatccgagagagagcttctgcctccatttaccactcccactccttcagctgcccttggtcttgccagacagcagattcagggaaagaaagctgcttcttaaaaactgtctgcctacctgattctgccacttacccacactgtctctagtctagagattgccagtggatagctaaattgtaaattgcaaattaggaagaaattcacacccagagccatttggaaatacaaaatggtacctctttccagtacctctttgctgtgggactggcccgccaggacccccaccccacctggcccgcagttgacattcagcttcccagctggcatcagcaaagagggtttgtccctctagcttccccagggctggcccactgctcaatgcgctcctggctccctgtaaaatcacagcccgcctgcactcctgagggcccctctcacagacagaccatctccctgtggttgtttgactgctcattttacctctggaatctgcctgggcttggaagaaagaggtcagccaggacattcccacgggcccgctgtcagctacatgaccttctcgcctctcaggctccccttcccccaggctcgtcctttttacacctcttctttgaaatctgaaccttccttgtagacttgcagccaatgaccagaagccaggaataaatcccatatttaaacaatattccttttttaactgcctcgatagaggtttattcttgttacttattataggcattttcaggcaagccatagcttggggcctccaggaagggaaagcttttgtttccactgatcattattttcagagatgtcctaactcccctgaggcccccctgcctccccctccccttcctaatgatccctcgcagagctcagactaagtgaaaagcttctttcattaacataagccattaatcgacttccccttgaagtaattcaggtctgcagaggggggaagactggtgttgggggcagtgggaagagggtggttccctgggggtctgtgatcagggctagaacatcaggaaaacccgaaccaaaaactgcaaaggtggcaggaagaagaaaaatcactgaaggctagacaagatgcatttgaaagataccaaccgcacagggaaagaaacaactttctctcacttctgcctcctatcattttattggagaacaaagacagcagtcaaacaacccaagaaagtaccctgtatgtttttcttcttccacatgtacccattttcccacctatctctccctgatttgtcttctttaaaaagacatttggggacctgagcaggtcttttagttgaatgcagcatgtgcagaaataactgcaaaagccaggagtgcatctccatcaacccatcaaaagaaaaatagaaatgtacatgggcatcgctgtctctagtcctctgtgatagttcactttgctaactagactacctttacttttcaaaatatctctaatgtctgctctggggtctaaatgcataaaacatctcccaagctgcagagcacagttattcagaattttatttgaacactgggttgggtcagcataggataaaccagcaaaaccttacttcatgagacctgccatccgtgtcccctgcagaaggaccgttcttggcctacttgttacctaatccaagcatccttggtggcctaagagggatcttttctcatctcctggacagtctgtggtcacaaaccttcttggtcaccacctctcccaccttttgtgcactcttccctgcctccttgagactgttcatcaccttgattttctaagagagctcaaatcatttccaaagcatgtggtgtggcctgtatagcttgctccagatttagctggagattaagaaacagccaggatattaaacagaaactctcagttgtatcagtgtagcaggccactggcacctaaacacgcaactggcatctcatttcgcctacagtagaaggaaaatgaaaatttgtacaaaaatgaaaacctaggaaatagtccacttgctcctatatttttaccaccttttctaactaaaatttccctgttgctctttggaatcaatccagaatgctcccaagtcccattattatcacagaatcttctcagtagggaaaaacaaacaactgcttcaaactgtgaattctgtatgtaccacattctatcccaggtattgggttttaaggcacccaactcacattcagtcctgctgcctgaatcatctcacaccagagtacagaccttggagacgcgatagatgggtcctagcctgaccttcaccactaagcggtacagggacccagatcttgctgtggagactgtaagtcgttgaacatctctagttctcactttccccgtgcacaaaataaaggattgggactagtctgctctccactctccagcattgtagaagacagtaatgaaaatagcttcatcttatctgccttcttatgctaaactcattttttttttttttaggtggagtttcactctgttgcccaggctggagtgcagtggtgggaactctgctcactgcaacctccgcctcccaggttcaagtgattctcccacctcagcctcccaagtagctgggaccacacgcatgcgccaccacgcccagctaatttttgtatcttttagtagaggtggggtttcaccgtgttggtcaggctggtctcgaactcctgacctcaagtgatcggcccacctcagcctcccaaaatgctgggattacaggcgtgagccactggcggcctcaactcatttttacaagcactaaataggtttagtttataaactgaaaaattaggaaataggcacgcataaaaagagtgtaggaagttgtttgggaagcccgcatggaataggccagaaagcacagtccccatgctgtctgccctgccagcatctcagcatcctgactagtatctctgttcactgcaggtttgacagttaccatcacccagccagaaaagggccccgccttgccagataaacgcgcttaggttagaagactataattgcaatattaccctacagctctcctgactgtttattccattattttcttgaaacatggccttaagtattatacataggcttcagaaacagtttttcagtgattttacctatattggcaaatagacaaatctcaccaaatcagagttcaggttttcaccaaaaactgcttagttgtctttcaagataccttaagagatcaaaggggaggtgggaaaagaaatgtagtgacagaagggagagtccaagataccactgataaggttccagcaaagagattaggacacagcagagactttctaaatgctggggtcatttccaaagcagtccaggggaatactttctgattccctctgccaatcaaaatagatagaatatgatattctccaattttttttctgtttgatgtcaaaatggcctttacctatttcttcagtaatatacctgatctgttcatgcactaaaggctctggagccaggaatgtctgaatttggccttcacctggtatcacagaaagacaactgggatattggtgttaaggggcatatcggctgtatgttaggttttctttaatcctcacatcgtgccaaacttagtctggttactaagcctaaaaacaccagtattgcaacaacttctgaaactctgaagtggactatatgtttctcacagtttttgtttatgctcagcaaagtatgtattttaagtaaagcttctcttgttatctgtaatgtagacaaaaaaaaaaaaaaacctgttagtatattctggatgtattgtgtgtcccttcattgtttcaggtatggcgtaacagttctccgtgtgatgttcttttgctctaaatgttgaccattcctcttgtcgcccgtctctcaccaaccagtcacagagccattgccagggctcccttcagtctttcttaaacaatatctaaatgcagtttagtaatcccaggattttgagttacaagaatacagtttatgggtctgtttcagctcttacttaaggctagcatggttgggcaggggaagagctgagccgagccttcactgatctcttgtcatttcatatgattatccagtaaatacttattgagcacctcccatgtgatacgtattgagacactgctgtgtgcaataattaagcctatggaggacttaaatgagggcaaggaaaacagaatgagagaagacactctcacactgacccccattacatgtgaaccctccgcgcccccccccataaatacaaagtgttatttttccacatttaaaacaaataatagccttcagcaggcagtgcaggaactattcagtcattgagataacctttgatgagaggagaaagctccttgattacctggtttttgttggagagactattaactagtacttggaaaatgagaaaaatgaaaccacacataagttgttcccttaaataatctcagcaggatattgcactaagatattattcaaggaaaagaatcaggagcagagatagccccatctctctagagcattttttttttttttttgggcgggggggcgggggacggagtctcgctctattacttaggccggagtgcagtggtgcaatctcggctcaatgcaacttccgcctcccaggttcaagcaattctcctgcctcagcctcccaggtagctgggattacaggtgcatgccactatgtccggctaattttttgtatttttagtagagacgaggtttcaccattttggccaggctggtctccaactcctaacttcaagtgatctacccaccttggcctcccaaagtgctgggattacaggcatgagccactacacctggcctaaagtcccgctttcttctgaggtgttcttttcatggtgtgaaaccagagacaggagctagggggtctgttccccagcgaatagtgttggggttttctcttcagagctaagtcagcaaagcctgcagctgctgccactcccctggtctgtgcctcccagggtgtttcctttctgattttgaagatttgtgggtgagtcaattatctttgcagacatcctaaagcagcttccctcctcgctaccctcagcagataagccatccagaaaacaggttctgacagccagtagcaggggtattttgggtttcagtttaaaactggtgcgtgttgttgcaagtgtcttgaagttgcaaaggatgtttggggttctagggcctgcaggggggcagagcagaaagagggtagttgtcagtgaccctctaccctcctctgagagccccattgccatttttgcccaccagttctcttcttacctcctcagggcagtgcccactcatttcctttatttcccttttgttttttttcttttcctcctctggtcgacaacctcttaattctagcagtgtacaaaagcaaggccaagctttcctggggcacttgggatgaaaggcccatccatgcctgttgtggaggcacagaggaggagaaggtgaagaacaggaatgggtgcagggggagtgtgaacgcaaggctgctggctttggcacagctccctgtgcagggctggatttccaattgcttttcagtgcctgtgccctgataggatgggcacagctggtatggaatcagagcagcccatctccagagcagaagtctgagagctcagcgtttgactcctgaaagaccaggatgttcctacctgggttcttgagattcattggctagtggaggtagatggtactctccatgtctgcagaagattccccacttggtgctgaaggctaggtgccttccagtcaggtctgaatgctgaaattgctgagattgtccactctctgcctactttattgcattcatgctccccttagatccaagagtgcccaggactaggagcagaaagcagttttcaaccctttgttcagactcagacgggtttcaactcaagcgggtaatctaccccagcagcaggggtgcaaagtccaaaacagctttgtggtgcctggggagtgactaggcagcctgctcacaggggctggagtcatctaaagctagtgatgagctggaatagctttgaaccggttcatccgaactgattgttaaactttcagaacttttgagagtcagttgagaaacatagctattactaaaaaattaaataagattagataaattatagctaaaagcaaaggcaacatatagtcaaagctcatcactttctacttattttactacattttaccattatctgtgcccatgaggtaatgtatgcctattatgtctgtatggtagaaatactgtatacaggtatactactacacacaccttcccaagtgacagtatttttgtagtttgagatcagctatagtggtggtatttataccatggaaagcaacaaagccatggaaagcaacaaagccatgcaaatcagactcctcctaacccctaagacagttgttaaacatttgccagcataccaccatctaaagccctaaagaatgcttggcctcccactgcatagacacaggccacatcacattgagtatcatggatttatgggtcagcattgcccctaagtccaaggaaggggaaagacttagcaagctcaacctcatgtgattcacaaagggtttctttctgcatttgtattgactcagaataggacccagtacagagaatccactgttatctatgggtgtcattccttcagaaagaatgtacagtaaaattggctatttcatgctatgcaaacaaaatgaaactagtttgaagttgcaaagtgtctcccctcttgcgcccacgtagtcatccaagaaggaaactcctttcttgccttgatattcaccaggcctacctagatagaacttgacaaattggcctaacttcatctccgctgctattgttatatatttgctttactgaatctatgtcctatgtcagtcagaagaaaaaagaaatgtcttttttaatatacactttcttagcatccatgcagttatgtatcctcatcctgatccaggaacatattgaacagatcatatgtcttttgttactatctagatacactaaataacatgatagaagagttttctctttcaggtgaacttccattttgaacatatgctaaacgtactatccactgtctattttaatgagatcttggcaatggtcctgtcggttttggtgtttggattgtttggctttgttttccttttttattcttcctgtttttaatgctgtgtaagatctcctgctatgaatgttccagttacccctattgtactgtatatacgtgtgctgcatgtgtaaattctgtttcaggttttggagttttcatcttaagtacagctggtcctgttgtgaactcatctttcctgtatgctcctctgtgtctgatttccaattgccaaaatgtttgaccaaatgtgttttgacaaatatcccgagacagccatgcgtatccttgtgaaagggcatgctccatgtgggatggctcgtgtacagcataaatctatcaaacttggaattgtgtatacatttatatgccagataactaacattcatgtaacagctgcaaagatatttagtgtatatcagattaataaaagagcattttttttttgctccattatattcaaataca

SEQ ID NO: 187981 - DNA, 497 bp, Homo sapiens
  Payload ID: 16995
  Gene Symbol: SYNGR1
  Gene Name: synaptogyrin 1
  ENST ID: ENST00000216155
  CDS Start-End: 63-419
cgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggcatgggagatgcactcttgaatgtccctctgttcctcggcttccccattttctccccactcaccctctcccccatgtgtggcactgcctattctgccc

SEQ ID NO: 187982 - DNA, 1361 bp, Homo sapiens
  Payload ID: 16995
  Gene Symbol: SYNGR1
  Gene Name: synaptogyrin 1
  Uniprot ID: O43759
  ENST ID: ENST00000318801
  CDS Start-End: 87-662
gcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattcattcattca

SEQ ID NO: 187983 - DNA, 4391 bp, Homo sapiens
  Payload ID: 16995
  Gene Symbol: SYNGR1
  Gene Name: synaptogyrin 1
  Uniprot ID: O43759
  ENST ID: ENST00000328933
  CDS Start-End: 16-717
gcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcatacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacagccccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcccccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaacccaccagcgattgcaa

SEQ ID NO: 187984 - DNA, 1295 bp, Homo sapiens
  Payload ID: 16995
  Gene Symbol: SYNGR1
  Gene Name: synaptogyrin 1
  Uniprot ID: O43759
  ENST ID: ENST00000381535
  CDS Start-End: 26-604
ccagcaggcatgcctccttggtctcatgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattca

SEQ ID NO: 187985 - DNA, 564 bp, Homo sapiens
  Payload ID: 16995
  Gene Symbol: SYNGR1
  Gene Name: synaptogyrin 1
  ENST ID: ENST00000406293
  CDS Start-End: 21-530
accgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagatctggggccacatcacctccatagccccatcccaagagccctccccataacccacagc

SEQ ID NO: 187986 - DNA, 928 bp, Homo sapiens
  Payload ID: 16995
  Gene Symbol: SYNGR1
  Gene Name: synaptogyrin 1
  ENST ID: ENST00000415332
  CDS Start-End: 25-459
gggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcgggtgagccccacccagcaggtaccccctgcacagagtctacagagggctgtcccggccataggaggcggctgccacccttcttcccatgtttcagatgaggaaatgagccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagca

SEQ ID NO: 187987 - DNA, 2325 bp, Homo sapiens
  Payload ID: 16996
  Gene Symbol: SYNGR2
  Gene Name: synaptogyrin 2
  Uniprot ID: O43760
  ENST ID: ENST00000225777
  CDS Start-End: 60-734
cggggcgccgggcaggttcctctgcgttccgcggcggcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccgcacaagcctttcatcaacatcttaaaatagtaactgtgctcagcttgtaaacaagatgatttttctggcctgcagtgccagggtcctgctgctcccttcctagagtgggggtgggggtacctgggagttgtcggtgaatgcccctttcttgcactgaataggggtaccataggtaagaccaggtttctaccttcctccagggtcagcacctctggagccttcctgggacacggccttggccgtccagcccacccctcggagataaggcccatctctggaagaggtcaaggccctaaagcaacttctggcttcttcttttgagcaatgacagagggagctgtcatcggcaagtcccgattgtttaaaaatccccagtacgaactaacagggcactgctcccagcctcacccgatggctttggcttgggacacatcactagcgaaggggagagggaggctggggaggccctgggagtggtgaccctgcctgcacaggacacaccttaccccagcgatgcttgcccccaagtgagctgccaacagcccatctctgaggcacagctgagagatgtcttgactcctgaattaccaagagtttgtttcacaaacaaaacctgacctcacaggcccagcgggca

SEQ ID NO: 187988 - DNA, 2239 bp, Homo sapiens
  Payload ID: 16996
  Gene Symbol: SYNGR2
  Gene Name: synaptogyrin 2
  ENST ID: ENST00000590201
  CDS Start-End: 142-648
ctcggggcaggccacgggtccgccttcccacccgaagttgagggaccccaagatgtaccccctccctgtaaggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccgcacaagcctttcatcaacatcttaaaatagtaactgtgctcagcttgtaaacaagatgatttttctggcctgcagtgccagggtcctgctgctcccttcctagagtgggggtgggggtacctgggagttgtcggtgaatgcccctttcttgcactgaataggggtaccataggtaagaccaggtttctaccttcctccagggtcagcacctctggagccttcctgggacacggccttggccgtccagcccacccctcggagataaggcccatctctggaagaggtcaaggccctaaagcaacttctggcttcttcttttgagcaatgacagagggagctgtcatcggcaagtcccgattgtttaaaaatccccagtacgaactaacagggcactgctcccagcctcacccgatggctttggcttgggacacatcactagcgaaggggagagggaggctggggaggccctgggagtggtgaccctgcctgcacaggacacaccttaccccagcgatgcttgcccccaagtgagctgccaacagcccatctctgaggcacagctgagagatgtcttgactcctgaattaccaagagtttgtttcacaaacaaaacctgacctcacaggcccagcgggca

SEQ ID NO: 187989 - DNA, 949 bp, Homo sapiens
  Payload ID: 16996
  Gene Symbol: SYNGR2
  Gene Name: synaptogyrin 2
  Uniprot ID: O43760
  ENST ID: ENST00000585591
  CDS Start-End: 24-698
gcggcagcggcggcgacggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcgggtcagcacctctggagccttcctgggacacggccttggccgtccagcccacccctcggagataaggcccatctctggaagaggtcaaggccctaaagcaacttctggcttcttcttttgagcaatgacagagggagctgtcatcggcaagtcccgattgtttaaaaatccccagtacgaactaacagggcactgctcccagcctcacccgatggctttggcttgggacacatcactagcgaagg

SEQ ID NO: 187990 - DNA, 2041 bp, Homo sapiens
  Payload ID: 16996
  Gene Symbol: SYNGR2
  Gene Name: synaptogyrin 2
  ENST ID: ENST00000589711
  CDS Start-End: 14-211
cggcgacggcgacatggagagcggggcctacggcgcggccaaggcgggcggctccttcgacctgcggcgcttcctgacgcagccgcaggtggtggcgcgcgccgtgtgcttgctctctggaccttcctgtggtttgttggtttctgcttcctcaccaaccagtgggcagtcaccaacccgaaggacgtgctggtgggggccgactctgtgagggcagccatcaccttcagcttcttttccatcttctcctggggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccgcacaagcctttcatcaacatcttaaaatagtaactgtgctcagcttgtaaacaagatgatttttctggcctgcagtgccagggtcctgctgctcccttcctagagtgggggtgggggtacctgggagttgtcggtgaatgcccctttcttgcactgaataggggtaccataggtaagaccaggtttctaccttcctccagggtcagcacctctggagccttcctgggacacggccttggccgtccagcccacccctcggagataaggcccatctctggaagaggtcaaggccctaaagcaacttctggcttcttcttttgagcaatgacagagggagctgtcatcggcaagtcccgattgtttaaaaatccccagtacgaactaacagggcactgctcccagcctcacccgatggctttggcttgggacacatcactagcgaaggggagagggaggctggggaggccctgggagtggtgaccctgcctgcacaggacacaccttaccccagcgatgcttgcccccaagtgagctgccaacagcccatctctgaggcacagctgagagatgtcttgactcctgaattaccaagagtttgtttcacaaacaaaacctgacctcacaggcccagcgggca

SEQ ID NO: 187991 - DNA, 2125 bp, Homo sapiens
  Payload ID: 16996
  Gene Symbol: SYNGR2
  Gene Name: synaptogyrin 2
  ENST ID: ENST00000589168
  CDS Start-End: 1-407
tggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattcagtctccagtcattggttgagccacagcctaggggttggaggaagactccactctgggtacacccttaggggctggctttatggaacttgtagtttgaacaaggcagtggcaatccgccccctccagcctgcctggctggcccccttccctctgtctggggtcgcattccgcacaagcctttcatcaacatcttaaaatagtaactgtgctcagcttgtaaacaagatgatttttctggcctgcagtgccagggtcctgctgctcccttcctagagtgggggtgggggtacctgggagttgtcggtgaatgcccctttcttgcactgaataggggtaccataggtaagaccaggtttctaccttcctccagggtcagcacctctggagccttcctgggacacggccttggccgtccagcccacccctcggagataaggcccatctctggaagaggtcaaggccctaaagcaacttctggcttcttcttttgagcaatgacagagggagctgtcatcggcaagtcccgattgtttaaaaatccccagtacgaactaacagggcactgctcccagcctcacccgatggctttggcttgggacacatcactagcgaaggggagagggaggctggggaggccctgggagtggtgaccctgcctgcacaggacacaccttaccccagcgatgcttgcccccaagtgagctgccaacagcccatctctgaggcacagctgagagatgtcttgactcctgaattaccaagagtttgtttcacaaacaaaacctgacctcacaggcccagcgggca

SEQ ID NO: 187992 - DNA, 796 bp, Homo sapiens
  Payload ID: 16996
  Gene Symbol: SYNGR2
  Gene Name: synaptogyrin 2
  ENST ID: ENST00000589183
  CDS Start-End: 16-357
ggcggcgacggcgacatggagagcggggcctacggcgcggccaaggcgggcggctccttcgacctgcggcgcttcctgacgcagccgcaggtggtggcgcgcgccgtgtgcttggaggcagaggatgcagtgagccgagatcgcactattgcactccagcctgggcaacaagagcaagactccatctcaaacaacaacaaaaacccaaaaggggacagcagtagtgggagaggccagcatctgtacaccccatcagggtccccgctgtgtgtgcccctcaggcggccaccagccctaccaggtcctcccctcccggcaggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctccc

SEQ ID NO: 187993 - DNA, 1553 bp, Homo sapiens
  Payload ID: 16996
  Gene Symbol: SYNGR2
  Gene Name: synaptogyrin 2
  Uniprot ID: O43760
  ENST ID: ENST00000588282
  CDS Start-End: 7-834
ggcgacatggagagcggggcctacggcgcggccaaggcgggcggctccttcgacctgcggcgcttcctgacgcagccgcaggtggtggcgcgcgccgtgtgcttggtcttcgccttgatcgtgttctcctgcatctatggtgagggctacagcaatgcccacgagtctaagcagatgtactgcgtgttcaaccgcaacgaggatgcctgccgctatggcagtgccatcggggtgctggccttcctggcctcggccttcttcttggtggtcgacgcgtatttcccccagatcagcaacgccactgaccgcaagtacctggtcattggtgacctgctcttctcagctctctggaccttcctgtggtttgttggtttctgcttcctcaccaaccagtgggcagtcaccaacccgaaggacgtgctggtgggggccgactctgtgagggcagccatcaccttcagcttcttttccatcttctcctgggtaggatggccaggggccggttcttgggtcaagggtggtggagggtggggtcccccacccacctgtaccctgctgtgctccccctgcagggtgtgctggcctccctggcctaccagcgctacaaggctggcgtggacgacttcatccagaattacgttgaccccactccggaccccaacactgcctacgcctcctacccaggtgcatctgtggacaactaccaacagccacccttcacccagaacgcggagaccaccgagggctaccagccgccccctgtgtactgagcggcggttagcgtgggaagggggacagagagggccctcccctctgccctggactttcccatgagcctcctggaactgccagcccctctctttcacctgttccatcctgtgcagctgacacacagctaaggagcctcatagcctggcgggggctggcagagccacaccccaagtgcctgtgcccagagggcttcagtcagccgctcactcctccagggcacttttaggaaagggtttttagctagtgtttttcctcgcttttaatgacctcagccccgcctgcagtggctagaagccagcaggtgcccatgtgctactgacaagtgcctcagcttccccccggcccgggtcaggccgtgggagccgctattatctgcgttctctgccaaagactcgtgggggccatcacacctgccctgtgcagcggagccggaccaggctcttgtgtcctcactcaggtttgcttcccctgtgcccactgctgtatgatctgggggccaccaccctgtgccggtggcctctgggctgcctcccgtggtgtgagggcggggctggtgctcatggcacttcctccttgctcccacccctggcagcagggaagggctttgcctgacaacacccagctttatgtaaatattctgcagttgttacttaggaagcctggggagggcaggggtgccccatggctcccagactctgtctgtgccgagtgtattataaaatcgtgggggagatgcccggcctgggatgctgtttggagacggaataaatgttttctcattc

SEQ ID NO: 187994 - DNA, 2051 bp, Homo sapiens
  Payload ID: 16997
  Gene Symbol: SYNGR3
  Gene Name: synaptogyrin 3
  Uniprot ID: O43761
  ENST ID: ENST00000248121
  CDS Start-End: 159-848
cgccgcggccggcgcgcgctcccgggaggcggcagcggctgcagcgttggtagcatcagcatcagcatcagcggcagcggcagcggcctcgggcggggccggccggacggacaggcggacagaaggcgccaggggcgcgcgtcccgcccgggccggccatggagggcgcctccttcggcgcgggccgcgcaggggccgccctggaccccgtgagctttgcgcggcggccccagaccctgctccgggtcgcgtcctgggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgcggacagagtaggtggccgctttgcgccatccggggccaagagggggtggacccgcgtgtctgggctgcccctgccaagttcccccagtccctcagcacctggccccaggactgaggtcctgagaaggggatagcactgcccaggacgtgtgtccctagcctggaatggactggcctggggaaggctttcccctcttgggccacacctgctcactctggggttgggggtccagctgccctctacgatcaggtgcaggggctgcccaggacaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagctgactgtga

SEQ ID NO: 187995 - DNA, 533 bp, Homo sapiens
  Payload ID: 16997
  Gene Symbol: SYNGR3
  Gene Name: synaptogyrin 3
  ENST ID: ENST00000568896
  CDS Start-End: 1-533
agctttgcgcggcggccccagaccctgctccgggtcgcgtcctggcccttactccgtttttcctgttctcgtgacctggaagcagggacggggtggggacggaattctccgaggggcaggagggggctacgggaaccgagaagcgcctccccttcccccgcacacacaccctcgggtctccttggcagggagcctgtcccctggcccccagttccagctgtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggactctggtccttcctgtggttcgtgggcttctgcttcctcaccaatcagtggcagcgcacggcgccagggccggc

SEQ ID NO: 187996 - DNA, 860 bp, Homo sapiens
  Payload ID: 16997
  Gene Symbol: SYNGR3
  Gene Name: synaptogyrin 3
  ENST ID: ENST00000563869
  CDS Start-End: 142-860
cctacccctttactccctcacccaagtgcccttcccagaggagcggactcctcctgtctgtcctcccggctctagcaaagtctgcgcccagcacccgagccccaccctgcccccggggacctggctggtgggttcctgaggatggtctccatctcgggaccggggcaggcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgc

SEQ ID NO: 187997 - DNA, 1743 bp, Homo sapiens
  Payload ID: 16997
  Gene Symbol: SYNGR3
  Gene Name: synaptogyrin 3
  ENST ID: ENST00000562045
  CDS Start-End: 1017-1247
ccgtgcagcgctggttaaaatgactgcggtccccctcatgcctgtctcccggaactggtgggcaggaggcattgaggtttgacggaacctcagaggtcaacggtgtcatcttttcagcccaaacacttacaggtgatattaataatcagtcacgtgggggctgtcatccctcgggtacccaccacgtgcaggaagctgggtggacatgtctgtcccagcactgcatgagctgtgcccgtcaccctatttgcatgctagaaaacaggccagacagttcccaaccgcgcaggaagcaacagctccgctgcctccataccctccctcccgccccgctctgcctgctgcactctcacctccccttcgccgttccggctccagcctgggaatcgcgggcccaggtgaaggctcctgttcccacactcttgagtgggctctgaggggactccacgggcccacgcggtgcagagtacctggcttgaatcaaccccggcttttgtcagccatgtgatcccggacaagtcacttcacctgttggggtcccaatgtcccccgcatttataaagagaataagaacaatggcgatcccacggggactttctgaggatttggtgaggggacgcatgtaaagtggctgtttaacacaatgtctgggcatagtagatgctcactaaacggcccgtgttgtcaataattactaaatacgcgagggttcgggaaagaaagaggtgacaccgccccccacccagatacgggcctgggaacgcagggacaggcccaggggcgtgggcgctcgaggcgggctcgcagaggtcgggtcgccgcagggccctgagcgccgcgccgcacgcaggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgcggacagagtaggtggccgctttgcgccatccggggccaagagggggtggacccgcgtgtctgggctgcccctgccaagttcccccagtccctcagcacctggccccaggactgaggtcctgagaaggggatagcactgcccaggacgtgtgtccctagcctggaatggactggcctggggaaggctttcccctcttgggccacac

SEQ ID NO: 187998 - DNA, 1213 bp, Homo sapiens
  Payload ID: 16997
  Gene Symbol: SYNGR3
  Gene Name: synaptogyrin 3
  ENST ID: ENST00000618464
  CDS Start-End: 105-542
atcagcatcagcatcagcggcagcggcagcggcctcgggcggggccggccggacggacaggcggacagaaggcgccaggggcgcgcgtcccgcccgggccggccatggagggcgcctccttcggcgcgggccgcgcaggggccgccctggaccccgtgagctttgcgcggcggccccagaccctgctccgggtcgcgtcctgggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagct

SEQ ID NO: 187999 - DNA, 1000 bp, Homo sapiens
  Payload ID: 16998
  Gene Symbol: SYNGR4
  Gene Name: synaptogyrin 4
  Uniprot ID: O95473
  ENST ID: ENST00000344846
  CDS Start-End: 251-955
ggggtggcgaaaggaagggcgggccctcaggtgacgcagattggccctccagagaaggggcggccccttctcaggtgccgtcacccccaaacctcagcactgccattccaggtccttaaaggggagaccgcgattctaagaagcagccaagcccagggctggcctgaagcccccggacggcagtgcccagcaggcagcgcccagcaccctggctcccacctcccagtggccccaaaggaaaacagctgccatgcacatccccaaaagcctccaggagctggccaacagcgaagccgtgcagtttctgagaaggcccaagaccatcacgcgggtcttcgaaggggtcttctccctgatcgtcttctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgttctctgggcagttgtctggttcatgggtttctgcttcctggccaaccaatggcagcattcgccgcccaaagagttcctcctggggagcagcagtgcccaggcagccatcgccttcaccttcttctccatccttgtctggatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaagtccccccggcttgctatgatgcctgacaactaaatatccttatccaaatcaataaagagagaatcctccctccagaag

SEQ ID NO: 188000 - DNA, 533 bp, Homo sapiens
  Payload ID: 16998
  Gene Symbol: SYNGR4
  Gene Name: synaptogyrin 4
  ENST ID: ENST00000595322
  CDS Start-End: 163-387
agtgagggaagcggagactctgcagggcctccaaggccaggcttcagggctgggactcagtcctgaggcactggggagccatgaggggctgtggcagggaggggcagggtcttctccctgatcgtcttctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtc

SEQ ID NO: 188001 - DNA, 365 bp, Homo sapiens
  Payload ID: 16998
  Gene Symbol: SYNGR4
  Gene Name: synaptogyrin 4
  ENST ID: ENST00000600863
  CDS Start-End: 93-365
gggtttggtggcagaaggagagtgtgggggaggcaggggtcttctccctgatcgtcttctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgttctctgggcagttgtctggttcatgggtttctgcttcctggccaaccaatggcagcattcgccgcccaaagagttcctcctggggagc

SEQ ID NO: 188002 - DNA, 859 bp, Homo sapiens
  Payload ID: 16998
  Gene Symbol: SYNGR4
  Gene Name: synaptogyrin 4
  ENST ID: ENST00000601610
  CDS Start-End: 168-608
ggaagagtgagggaagcggagactctgcagggcctccaaggccaggcttcagggctgggactcagtcctgaggcactggggagccatgaggggctgtggcagggaggggcagggtcttctccctgatcgtcttctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgttctctgggcagttgtctggttcatgggtttctgcttcctggccaaccaatggcagcattcgccgcccaaagagttcctcctggggagcagcagtgcccaggcagccatcgccttcaccttcttctccatccttgtctgggccagtccccagcccagtccctctcctgacctgcccagcccaagtcagccttcagcacgcgcttttctgcccacagatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaagtccccccggcttgctatgatgcctgacaactaaatatccttatccaaatcaataaagagagaatcctccctccagaagggtttctaaaaac

SEQ ID NO: 188003 - DNA, 7059 bp, Homo sapiens
  Payload ID: 16999
  Gene Symbol: SYNJ1
  Gene Name: synaptojanin 1
  Uniprot ID: O43426
  ENST ID: ENST00000357345
  CDS Start-End: 126-4013
aagccggcggggggcggggagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttaccatg

SEQ ID NO: 188004 - DNA, 6958 bp, Homo sapiens
  Payload ID: 16999
  Gene Symbol: SYNJ1
  Gene Name: synaptojanin 1
  ENST ID: ENST00000382491
  CDS Start-End: 118-3912
atgcggaagagatgggcctgctggagcggaagtgacgctcccggcggctgtggcggcggctgcgggagaaggaggaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaaggctggaaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttaccatg

SEQ ID NO: 188005 - DNA, 7094 bp, Homo sapiens
  Payload ID: 16999
  Gene Symbol: SYNJ1
  Gene Name: synaptojanin 1
  ENST ID: ENST00000382499
  CDS Start-End: 1-4053
atgcggaagagatgggcctgctggagcggaagtgacgctcccggcggctgtggcggcggctgcgggagaaggaggaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtcttta

SEQ ID NO: 188006 - DNA, 422 bp, Homo sapiens
  Payload ID: 16999
  Gene Symbol: SYNJ1
  Gene Name: synaptojanin 1
  ENST ID: ENST00000418301
  CDS Start-End: 1-395
aagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagagcaaccatcagggtaacaggtaaaaacaaatggaatctctgat

SEQ ID NO: 188007 - DNA, 3604 bp, Homo sapiens
  Payload ID: 16999
  Gene Symbol: SYNJ1
  Gene Name: synaptojanin 1
  ENST ID: ENST00000438952
  CDS Start-End: 1-562
gccgccccgcccggtcgcccctcccacacgcccggctcccccacagagacctcctccgccttcaggggctaggagtcctgcacccactagaaaggaatttggagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaacaggagcaaccatcagggtaacaggtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtctttac

SEQ ID NO: 188008 - DNA, 4852 bp, Homo sapiens
  Payload ID: 16999
  Gene Symbol: SYNJ1
  Gene Name: synaptojanin 1
  ENST ID: ENST00000433931
  CDS Start-End: 9-4847
gcggcgcaatgcggaagagatgggcctgctggagcggaagtgacgctcccggcggctgtggcggcggctgcgggagaaggaggaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgtttctgagcagacattacagtcagcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggggctaggagtcctgcacccactagaaaggaatttggaggtattggagcccctcccagtcctggggtagctaggagagagatggaagcacccaaaagccctggaacaacaaggaaagataatataggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgcca

SEQ ID NO: 188009 - DNA, 583 bp, Homo sapiens
  Payload ID: 16999
  Gene Symbol: SYNJ1
  Gene Name: synaptojanin 1
  ENST ID: ENST00000456084
  CDS Start-End: 48-583
gctttgctttgcttggttttcgcagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggtt

SEQ ID NO: 188010 - DNA, 2212 bp, Homo sapiens
  Payload ID: 16999
  Gene Symbol: SYNJ1
  Gene Name: synaptojanin 1
  ENST ID: ENST00000429236
  CDS Start-End: 126-2212
aagccggcggggggcggggagctgctgcggccagacccacgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaaggctggaaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaa

SEQ ID NO: 188011 - DNA, 6898 bp, Homo sapiens
  Payload ID: 16999
  Gene Symbol: SYNJ1
  Gene Name: synaptojanin 1
  ENST ID: ENST00000630077
  CDS Start-End: 87-4667
cgggcagccgggcgggcggacgcctccaagaccagtctctgcctccgcagcgtcagcgggagcgggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaagaggcaatcaagggtacatactccaaagtactggatgcatatggactcttaggtgttctgcggttaaatcttggtgatactatgttacattatctggtcctagtcactggatgtatgtctgttggaaaaattcaagaatctgaagttttccgagttacttccactgagtttatatcactgcgaatcgattcttcagatgaggatcgcatttcagaagtgcggaaagttttgaattcaggaaacttttattttgcatggtctgcatctggcatcagtttagatttgagtcttaatgcgcatcgtagcatgcaagaacagacaactgataatagatttttctggaatcagtctttgcatttgcatctcaaacactatggcgtgaattgtgatgactggttattacgtcttatgtgtggaggagtagaaatcagaacaatttatgctgctcataaacaggcgaaggcttgcctcatttcaagattaagctgtgaacgagctgggaccaggtttaatgtccggggaacaaatgatgatggtcatgttgccaattttgtagaaacagaacaggttgtgtacttagatgactcagtttcttccttcatacaaatccgaggatctgttccattgttctgggagcaaccagggttgcaagtgggatctcatcgtgtccgtatgtcaaggggatttgaagccaatgcacctgcttttgacaggcattttagaacacttaagaacttatatggtaaacaaataatagtaaatttgcttggatctaaggaaggtgaacatatgctaagtaaagctttccagagtcatttgaaagcttctgaacatgctgctgatatccagatggtgaattttgactatcatcaaatggttaagggaggaaaggcagaaaaattacatagtgttcttaaacctcaagtccagaagtttctagattatggatttttttatttcaatggaagtgaagttcaaagatgccagagtggtacagttcgaacaaactgcttggattgtcttgatagaacaaatagtgtgcaggcatttcttggcttagagatgctagctaaacagttggaagctcttggtttagctgaaaagcctcagttggtgactcgctttcaagaagtttttcggtcaatgtggtccgtgaatggtgattcaatcagtaagatatatgcaggaactggagctcttgaagggaaagcgaaggctggaaagttaaaagatggtgctcgctctgttacccgaacaattcagaataacttctttgacagctccaagcaagaggccattgatgttttgctactgggaaatactctgaatagtgatttagctgacaaagctcgagcacttttaactactggaagtttgcgtgcatcttctaaagtactaaagagcatgtgtgagaatttctacaaatattcaaagcctaagaaaattcgagtatgtgtcggaacctggaatgtgaatggtgggaagcaatttcgcagcatagcttttaagaatcagacactcactgactggcttcttgatgcacccaagttagctggcatccaggagtttcaagataaaagaagtaagccaactgatatatttgcaattggttttgaagaaatggtagaattgaatgctggaaacattgtgagtgcaagcacaacaaatcagaagctctgggctgtagaacttcagaagacaatctccagagacaacaagtatgtgctgctggcttctgaacagttggtgggcgtctgtttgtttgtttttatcagaccacagcatgctccttttatcagggatgttgcagttgatactgtgaagactggaatgggaggtgcaactggaaataagggagcagttgcaatccgaatgctcttccatacaaccagcctttgcttcgtctgtagccactttgctgcagggcagtcacaagtcaaagaaagaaatgaagattttatagaaatagcacgaaaattgagttttcctatgggaaggatgctattttcccatgactatgtattttggtgtggtgatttcaactatcgaatcgatctccctaacgaagaagttaaagagctcataagacagcaaaattgggattctcttatagcaggagatcaacttatcaatcagaaaaatgctggacaggtttttagaggatttttagaaggaaaggtaacctttgctccgacatataagtatgacttgttttctgacgactatgacaccagtgaaaagtgccgcacccctgcctggacagaccgtgtcctttggagaaggaggaaatggccttttgatagatcagctgaagatctagatcttctaaatgctagttttcaagatgaaagcaaaattctgtacacgtggactccaggcactttgctgcactatggaagagctgagctgaagacttctgaccacaggcctgtcgttgccctgattgatatagatatatttgaagttgaagctgaagagaggcaaaacatttataaagaagtaattgcagttcagggtccaccagatggtacagtattggtctcaatcaaaagttctttaccagaaaataatttttttgatgatgccttgattgatgagcttctgcagcagtttgcaagttttggtgaagttatacttataagatttgtagaagataaaatgtgggttacatttttggagggaagctctgccttgaatgttctgagcctaaatggtaaagagttattgaatcggactataactattgctttaaaaagtccagactggatcaaaaatttggaagaagaaatgagtttagagaaaattagcattgcattgccatcatcaacaagctctaccctgcttggtgaagatgcagaggttgcagcagattttgatatggaaggtgatgttgatgactatagtgctgaagtggaggaacttcttcctcagcatctccagccatcttcaagttccggccttggtacttcccccagctcttcaccccgaactagtccctgccagtcacctacaatatcagagggtcctgtaccttcccttcccatcagaccaagccgagcaccgtcaagaactcctgggcctcccagtgcacagagttctcctattgacgcgcagccagcaacgccgctgccgcagaaagaccccgcccagcccttggagcccaagcggccgccgccgccccgcccggtcgcccctcccacacgcccggctcccccacagagacctcctccgccttcaggacgcagtcagccttcacctcaagcaggacttgcaggcccaggacctgctggatacagtacagccagaccgacgattcctcctcgtgctggagttatcagtgccccacagagccacgcgcgggcatctgctggaagactgactcctgaaagccaaagcaaaacatcagaaacgtcgaaaggttcaactttccttcctgaaccactgaagcctcaggctgcttttcctccgcagtcttctttgcccccgcctgctcaaaggttgcaagagcctcttgtccctgtggcagcacctatgcctcagtctggcccccagccaaatttggaaaccccaccacaaccaccacctcgaagcaggtcatcccatagcttgccttcagaagcttcctcacaaccgcaagtaaaaacaaatggaatctctgatggcaaaagagaatcaccattaaagattgacccatttgaagatctgtcatttaatctgcttgctgtatcaaaggctcagctatctgttcaaacgtcacctgttcccaccccagacccaaagaggttgattcagttgccttctgcaacgcaaagtaatgttttgagttctgtaagttgcatgccaacaatgcctccaattccagctcggagtcaatcccaggaaaatatgcgaagttctccaaacccatttattactggcttgaccaggacaaatcctttcagtgacaggactgctgctcctggaaacccatttagagccaagtctgaagaatcagaggcaacttcatggttctccaaagaagagcccgttactatcagtcctttcccttctctgcagcctcttggtcataacaaaagcagggcttcatcttcacttgatggctttaaggacagttttgatctacagggccagtctacattaaaaattagcaacccgaaaggatgggtaaccttcgaggaagaagaggattttggtgtgaaagggaagtcaaagtcagcttgttcagacttactgggtaatcagccaagttcattttctggctccaacctgacattgaatgatgactggaataaaggtacaaatgtctccttctgtgtgttgccgtcaagaagacctcctccacctcctgtccctctgctcccgcccggcaccagccctccagtagatcctttcacgaccttggcctctaaggcttcacccacactggactttacagaaagataacgccatgcaatagaaaacagtgggtacttgcttttggcaggatagagctaagagaattgggcattagtatttcattatgtgcaataagtcattgtaagtgcactgatatcttcacaaaacaccactatttgatgtgtacagagttggactatgtgtatattggaaataaggaaaaacccttctcattgttaactggagttttgatgtatttctctttggatgaataggagacagtagtagccataaaaagtacttatactttagaaaacagtccttattcagaaacttttcggtcagtcttctgaagaatctcaaaaagcccacccaactttcagctgacatttccaccagccctctcatacttgttaacaattggtatctttgagtatttaccaaagagctgccaaggttacagtgaacagagttttgaaaggcattgctttaaaggaaaaaagtataggtatgtgtacatatataatacatacaaacacatgtacttctgtatacatttacatatttttacaattcatactttaatttctaggctataactcagaccaaattatacctaaaagttccaacaaagtccctttttcaatatcacattaccaaaaagatggctgcaaatgtaatttggacctttcattaattttgttttcaaaactagaataatctcaccacagaatcagaattttctaccgttccacacccaaccccttcaaatacacacaaccttgttacttttcactccagcaccttcatacgcttttctccaggaggaggttcttgcagctggaaacagcctattttgtggtcactgtcaagtggatggatattctagcgctcccaaaaaagcactatggccttatatgcagggaaggcacataccaccaagttcaatgagaaatattagagctaaccgtactctcttctctgcgtacgttcgagtatacgttgcccatatccctcccatattttctttttgctgcttttgctctggaactttgcttttagcagggaaagcagctgtcccctgagtgctttgaattgggaatatacccagtgtgtgttctcccccctcttacgaggctacataacacatctatgatgctgctttaagtttttagaggctatacctcaaagtagctgcggattttgtctcctgcactgccaatatgcaactgatcccgcttttattaattttttgaagaagtacacagaatttttacagaatgtagtattttgatatcattaagtaaaccaatcagaaaactccttgagcaatagttgtttctttgtcagtttcagttacaatcatctttacccattaagacttacattaacattccttttatataaagagttgtatatgtccacctaaattcctatgtccacacttaacctttaaagatgtacattgagggaatatcaaaaaatagcgttcatggctacgaatatgtagaatgttaaaagcacagcaaactgcactgcacttataaagcaaatctattagaaaaaaagcatttttctaaatgctcaaatgttatcaaaatactatatttatagaagtaatcttctctgttaacagccaagatttgctgttagaaataactcttgtgagttttatattgtgctttttggaggttctaatcatttcagcagtagcgtcttaaacagcagtattactataagcagttgcttcaaaatgtgaattaacttgttgaaactgtggctttaacatccatgtgactagtgtatatggtatttgctctccattagcaaaataattcattgttaggtaaacttcactagtgcaaattgcagatctgtgagcaatgtttcctattgaatataaactactgtctaaaatatacatatcagcagcccagcctttatcaggaaaattatacttggcaagttgctgaaaatgcacaaagttatgaaagttaaaggtatgctgcaaataactagccattattctatgtattattaaatatttactagttctgttaaaagcagagcagaagttagacactaaggatctctttgtgaactctgtgttctctatattagattgctgtttatatgtaagaattttattgcttatgtggcatacaatatttataactataaactttatagaagtacagtattaaagtcagtggtacacagacattctgtacatatcctgtgaaacgtgctgtcatatgaaataaatatatctgtcttta

SEQ ID NO: 188012 - DNA, 7378 bp, Homo sapiens
  Payload ID: 17000
  Gene Symbol: SYNJ2
  Gene Name: synaptojanin 2
  Uniprot ID: O15056
  ENST ID: ENST00000355585
  CDS Start-End: 76-4566
gcggggagctgtcgcgggcagcgcgccctcgggaggacgtggccccggcccccgcccgcagtgggcccgaccctcatggccctgagcaaagggctgcggctgctggggcgcctgggggccgagggggactgtagcgtgctgctggaggcgcgcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctggaaccagctgttgcacgtgcccttgaggcagcaccaggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaagaagctgctctgggcttcttgccacgcgggcgacacgcctatgatcaattttgacttccatcagtttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgaggtcctgcatctgcagctcaagaccctggggctgagttcaaaacccatcgttgaccgctttgtggagtccttcaaagccatgtggtctctgaatggccacagcctgagcaaggtgttcacaggcagcagagccctggaagggaaggccaaggtggggaagctgaaggatggagcccggtccatgtctcgaaccatccagtccaacttcttcgacggggtgaagcaggaggccatcaagctgctgctggttggggacgtctacggcgaggaggtggcagacaaagggggcatgctgctggacagcacggcgctcctggtgactcccaggatcctgaaagctatgactgagcgtcagtccgaattcacaaatttcaagcggatccggattgctatggggacctggaacgtgaacggaggaaagcagttccggagcaacgtgctcaggacggcggagctgacagactggctgctcgactcgccccagctctcgggagctaccgactcccaggatgacagcagcccagctgacatatttgctgtggggtttgaagagatggtggaattgagcgcagggaatattgtcaatgccagtactaccaacaagaagatgtggggtgaacagcttcagaaagccatctcacgctctcatagatacattctgttgacttcggcacagctggtgggcgtctgtctttatatctttgtacgtccataccatgtcccgttcatcagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaaggaatccgtgacccacagagctagacagataagatgcatagttgaccagtcataaaaggcggtgtttaggtgatcaggatgccgttggtggcatttacgtgctttatatgatttttacctctgtaacaaacacaagaaataaacagaatggtccttaacagagtttgggggagagagcaagatgggttccttggagaagctgatttgccaagatgcacatcgctattaacagccagagtcataaatgaaatgaaattgaagaattcattcaaatgctcttttccctataacctcttttctcaccaaaaaggagataaatttgaaaacagataaatgtaacaaccagtcaaagaagcaggggaaaagtaagctcctccaaagttgcttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaacaacatagattggatttggagttggtagtaggtatggttctcataccagaattctcttaaaaaaaaaaaaaaggacaattggaattgccttatttatttttaaaatcaatgcttactagttggtaggattcccaggtcagcagcagggttgattaaataatcttgacaatgagcagctgccatcttgggggatttcattctgtggttttttaaatgtttcgtctttgatgctaccatccagggcttcttattgtgaccttgtagcctattttgttcctgctgttctctaacatggtgcagttcacgcagactggtttaggtacttcacaactcaccattgtctctctgaccccaagcctagtcccttttacatcaccatcttctcagacttcttgcctattcttaaaatatgttttggttaatgattgaattaggacatcagcttaagcaattcctgtaacggtttaacgttgttgaagttcaaggcacataataaaattctccctgatgtgtgtgtaagtataaacaaagtaatgtatcaaagcgttcactttataatgaagtcatttcattgggaaggaaagctgcaaagattattgggggactagtgattaataaaatcctgtaatatttttgaagtgaaaatttgtactgaaattgtacatgatacctattaaatgtttttgtctttttttaaa

SEQ ID NO: 188013 - DNA, 5091 bp, Homo sapiens
  Payload ID: 17000
  Gene Symbol: SYNJ2
  Gene Name: synaptojanin 2
  ENST ID: ENST00000367112
  CDS Start-End: 1856-3601
cctaattacacattttgggagagcatagccaggaaattgcatctgtgaaaagaaaatacaaattttcctctagatgagtttgtgaacgcctgtgtggccccagcgctctgagaggtggggcctagaatgagtccgagtgttctcagctcctgcagctcttaccataccaattgctgccaaccttctgggattcctgggtcctggaaacccggcagcaacactgtgtctcaagcctacagtgggcatgctggcgaggactgcaggcatggtcatgactgttttgaataattatatgcgaggaatgtttttaaccaaaggccccaaagcatccgaagcctggcttcaaggtggaggagtaaggaggatgagtctgggacgtggggtggttcgtggcgcagacctctattgtggaagtgtcatgatcgcattcttggatattgactcgattctatatgggtctctcgaatggaacccctgcgagtagctggagaactcaaccttctagacagtgatctagatgttgacaccaaagtcagacacacctggtctcctggtgccctgcagtattatggtcgtgcggagctacaagcgtctgatcacaggtgaggtcctgacttccatggcgttttctcctgtgctgggcaaggcagcgtctccctctccgcaggaaaatgcatgctgtccccataaggatgtgtgtgcgcatgggggtgcattttgtgtgcatacaatacaccaaagaacaaagaatgatggaacaaatatctgtggacccaccaccaagaactaattaatcttagcattttgtcattgctccatatcataaatgacatcattgatgaaaatttcaaagatgcaacctacgtattttgcggcttttatattttcttaaatgatgtcgttgtgcaacttgcttttttgttactatttttgagatacagtcgtgttgatgttatagctctggtgcattcatttgtaactgctgtctagtatcccactaaatatatccatggaacttacaacttatccattcacctcttgatgaatattttctccaggattttatgattacaaacaccatagggtttttaaatctgggatgcacaaccttttttttttttttttttttgagagagagtcttgctctattgcccaggctggatggagtacagtggtgtgatctcagctcactgcaacctccgcttcccagattcaagcaattctcctgcctcagcctcccaagtagctgggattacaggtgcacaccaccatgcctggctaatttttgtgtttttagtagagacggggtttcaccatgttggccaggctggtcccaaactcctgacctcaggtgatccacccaccttggcctctcaaagtgttgggattacaggcgtgagccaccgcacctggccctaggatgcagggctttttaaatgctctgtgcatcatgcattgaggatagagtggaggcagcagagggagcaccgtgggcaccagcacctgtgccctgggattgctgcagaggaagactcaccctgcagaatgtctttaaagacagaggagaggatggcatttgagggtgtgaagaaggaagagtttgatcttcccaaggctgctgcctaaactctcatgtcagtttcaacttttacaaggaaagaaattaagaaaaagaagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggccaaaacgtttgtgcatctgtcactctcgtgtagtttacaaaaatcgtgtctcttattcagtaagatggttactcagccaccaaaatatatttcactcaaggcttgtacatctgaagtttgctcttcaaggaatgggaaccttcctgttaaattcggtgtatggattttaagaaaggaatctagccaatgaggtccaagaagttctcacccattgaatttttaaatggctgttcagttcatgttgtacgtgatggagatttgtcttttgttttatttgcattttacagatttggtataacattttggggagccacctgaaggttgatgtataaagtaaggattagagaaagaggtcgttgtgaccattagtagctgtcctggcccacttaaacaaggttacaaaaaatcagagtcggaagcagccaaataggtcaacctaatgactagactgtacattcccatgagccttcatgtttaagtgtgtacatgtgcgttaaccttgatgatgcgtgaatcccgagggagccggtggcatacaccgttagcttaaccttagcttaaactagctgaaggctcctgtgccatgtcttagacattgcatgccctatcaattactataatcctgagccatggtgtgctactgaaaccaatttttatccaccatctagtccttattaaatgaaacctcacggatcctttgttccgcttatattccatgcataccacataaaagcacacagtgcgaaaactcttgctgatacgcgatattgattctcattgttagaatatggagagtgtttcagcctcgtctgtccggctggagcttcgggatggaaagtgctatgtgtccctgcatataagaatcaccaggccagtgtttctgggtttgcttgtctatatgtttgtctatattttttgcctatacatttttcccacgtttccaacagcacttctcacctattcaataactgaaaaagacattaccatagtgctttacatttttaaagtaatgttacaaggtctggaatccatttggagcagataccgtgttttcgctatttaataagaagttcagtagtgaaatcttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaagatatattgcagattacttaaatatggccatcaaaacaaaagttacaacacgtatctcttttcatctgaaaactaatacctggaaaaggataaaaaaaaaaa

SEQ ID NO: 188014 - DNA, 499 bp, Homo sapiens
  Payload ID: 17000
  Gene Symbol: SYNJ2
  Gene Name: synaptojanin 2
  ENST ID: ENST00000367113
  CDS Start-End: 1-410
gcggccgcgacgactgcctgctgttcgaggccggcacggtggccacgctggctccagaagaaaaggaagtcattaaaggacagtatggcaagctcacggacgcgtacggctgcctgggggagctgaggctgaaatctggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactgtccgcacgcagaagcagggggatgacagctctgaatgggggaactccttcttctgaggcagccacaggttttcatctggccttggtgctttggattccccagaagtgaattcctgatttctgccggaagaaggggaccctcccca

SEQ ID NO: 188015 - DNA, 3029 bp, Homo sapiens
  Payload ID: 17000
  Gene Symbol: SYNJ2
  Gene Name: synaptojanin 2
  ENST ID: ENST00000367122
  CDS Start-End: 411-2930
atcagaaagggggcgagcttaggggcggcattcctcttggggtgtgggtgtgggtgtttggatgctggaggaactcatcttttccccagcttgtggttggcctcatcttaccacctgggcctacccatggcttttgaatttccaccagcctttcggcgagctggcagcaggcgttgaactgacctccccactgagcccctgggtcccgggaagggcctgtgcctgccaagagcaccacgggtacacccctgcagcacctggagactaagactatgctgcccataatcctcttctctgactttcagaagatgtttaggtccctgtccctctgcttgtgttatttgggcagcttggcagtgtcctaggttagcaggtgaagggacgtagccatcgacacagtgaagacgggcatggggggcaaggcggggaacaagggcgccgtcggcatccgcttccagttccacagcaccagcttctgcttcatatgtagtcacctgacggccgggcagtcccaggtgaaggagcggaatgaagactacaaggagatcacccagaaactctgcttcccaatggggagaaatgttttttctcatgattatgtattttggtgtggcgatttcaactaccgcattgatcttacttatgaagaagtcttctattttgttaaacgccaagactggaagaaacttctggaatttgatcaactacagctacagaaatcaagtggaaaaatttttaaggactttcacgaaggagccattaactttggacccacctacaagtatgacgttggctcagccgcctacgatacaagcgacaaatgccgcacccccgcctggacagacagggtgctgtggtggaggaagaaacatccctttgataaaacagctggagaactcaaccttctagacagtgatctagatgttgacaccaaagtcagacacacctggtctcctggtgccctgcagtattatggtcgtgcggagctacaagcgtctgatcacagacctgtgctggcgatcgtggaggtggaagttcaggaagtcgatgtgggtgctcgggagagggttttccaggaagtgtcctccttccagggccccctggatgccactgttgtagtaaaccttcaatcaccgaccttagaagagaaaaacgagtttccagaggacctgcgtactgagctcatgcagaccttggggagttatgggacaattgttcttgtcaggatcaaccaagggcagatgctggtaacttttgcagacagtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtcagaaggggatattcttgaagacgatgaagactacttggtggatgaattcaatcagcctggagtctcggacagtgaactcgggggagacgacctctctgatgtccccggccccacagcactggctcctcccagcaagtcacctgctctcaccaaaaagaagcagcatccaacgtacaaagatgacgcggacctggtggagctcaagcgggagctggaagccgtcggggagttccgccaccgttctccgagcaggtctctgtcggtccccaaccggcctcggccacctcaacccccgcagagacccccccctccaaccggtttaatggtgaaaaagtcggcttcagatgcgtccatctcctccggcacccatggacagtattcaattttgcagacggcaagacttctaccaggagcacctcagcaacctcccaaggctcggactggaataagtaaaccttataatgtcaagcagatcaaaaccaccaatgcccaggaggcagaagcagcaatccggtgtctcctggaagccagaggaggtgcctccgaagaagccctaagtgccgtggccccaagggaccttgaagcatcctctgaaccagagcccacaccgggggcagccaaaccagagaccccacaggcgcccccactccttccccgtcggcccccacccagagttcctgccatcaagaagccaaccttgagaaggacaggaaagcccctgtcaccggaagaacagtttgagcaacagactgtccattttacaatcgggcccccggagacaagcgttgaggcccctcctgtcgtgacagcccctcgagtccctcctgttcccaaaccaagaacatttcagcctgggaaagctgcagagaggccaagccacaggaagccagcatcagacgaagcccctcctggggcaggagcctctgtgccaccacctctggaggcgccgcctcttgtgcccaaggtacccccgaggaggaagaagtcagcccccgcagccttccacctgcaggtcctgcagagcaacagccagcttctccagggcctcacttacaatagcagtgacagcccctctgggcacccacctgccgcgggcaccgtcttcccacaaggggactttctcagcacttcatctgctacaagccccgacagcgatggcaccaaagcgatgaagccagaggcagccccacttcttggtgattatcaggaccccttctggaaccttcttcaccaccctaaactgttgaataacacttggctttctaagagctcagaccctttggactcaggaaccaggagccccaaaagagatcccatagacccagtgtcagctggcgcttcagctgccaaggcagagctgccaccagatcatgaacacaaaaccttaggtcactgggtgacaatcagtgaccaagaaaagaggacagcactgcaggtgtttgacccactggcaaaaacatgactgagcagctttgaaggctgcagtcctatagaatgcataccttcctccctctagacatccctccaccagaagagacatctatttaaaggcacactggcc

SEQ ID NO: 188016 - DNA, 547 bp, Homo sapiens
  Payload ID: 17000
  Gene Symbol: SYNJ2
  Gene Name: synaptojanin 2
  ENST ID: ENST00000449320
  CDS Start-End: 271-547
agtgcaatggcgcgatctcggctcaccacaacctctgcctcctgggttcaagcaattctcctgcctcagcctcctgaatagctgggactacaggcatgcgccaccatgcccaactaattttttgtatttttagtagagacggggtttttccatgttggtcaggctggtctgaaactccgacctcaggtggtccacctgcctcagcctcccaaagtgctgggattacagccatgagccgccgtgcctggccgacctctcttctcttttaagatgtttctttatgcctcgggacctgctcctcctgcaggaacctgcaggtggggaggtcaaggtggcacgtctctgagcttcctggtgttggtgacaggctgcacatctgtgggcagaattccagatgctgaaatctacaaaatcactgccactgacttttaccctcttcaggaagaggccaaggaggaggaacgcctcatagctttgaagaaaatcctcagctcgggggtgttctatttctcatggccaaacgatgggtctcgctttgacctgactg

SEQ ID NO: 188017 - DNA, 810 bp, Homo sapiens
  Payload ID: 17000
  Gene Symbol: SYNJ2
  Gene Name: synaptojanin 2
  ENST ID: ENST00000485863
  CDS Start-End: 1-497
aggtgagctgctgtgactggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagatgatttacatggacgatggagtgtcatcttttgtccagatcagaggctccgttccgctgttctgggaacagccagggcttcaggttggctcccatcatctgagactccacagaggcctggaagccaatgcccctgctttcgacaggcacatggtgcttctgaaggagcagtacgggcagcaggtggtcgtgaaccttctgggaagcagaggcggagaggaggtgctcaacagagccttcaaggtaaggccaggctgtcctctccacagctgggctgggcggcaggtggccatggtggagcgttgagcctggaggtggctcctgcagggactggagctgacagcccagccctccttcgtttcctgaggcttccccagcattccgaccagtgaacacggcagtgctcagtgactcgggccctgatacatttgccaaaggtgggaagctagagaaattggagaccctcttgaggccacagttaaagctgcactgggaagacttcgatgtgttcacaaagggggagaacgtcagtccacgttttcagaaaggcactttgcggatgaactgtcttgactgcctggaccgaaccaacactgtgcagagcttcatcgcgctcgag

SEQ ID NO: 188018 - DNA, 7015 bp, Homo sapiens
  Payload ID: 17001
  Gene Symbol: SYNJ2BP
  Gene Name: synaptojanin 2 binding protein
  Uniprot ID: P57105
  ENST ID: ENST00000256366
  CDS Start-End: 83-520
gggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaaggtattgtttgaaggaaaactgaagaaaagacttggcttagaacaaatgaggagttatatattttactaggacttttgatagaaattcagctacaacccaaagagagaaagattgagtcttcctgtcaccataggcaataccttttttcttagctggcatgccataaaggccagctatgtgatattagaggaagaaaggatttttctttttaatgatcttccttgggaaattattgtggcctttatttaatttctaactacgtacctgggtgcctatatcgacaaagagtgagaagagcatttttacttttttaaaaaagcaaatacatatatacacatacgtatgcaaatattatagtataatagtgatccctatggagaattaaaggtgagaaagctactttgtggtgtctaggtttctgataaaagggatgatcttaactgaagaatttaaagagatacttaaacagagcaaatgtagtaggaacaagggagtgagccttataagaggacgttcagtctcatttattaaaataataactgagactgggagaggtggctcatgcctgtaaatcccagcactttggtagcctgaagtgggagattgcttgagtccaggagaccagcctgggcaacatagcaaaacctcatctctatttaaaaaaaaaatagaaaaaaatgtaataactgaagcaactaattaaaaatcttagaagaacaatatttattcttataacagccaactatggtgagttattataaggtaaattgccataatccagcgctgctcacatctaaaaaactttgaggtgtaaaggtaaatcgtaccaatctctgggctgccctagtgacttttttgatacctcagagtcctattgaagaaccaggtggaatgattgtggtaagggctatagtgctggagccaaacaccccagcaagaaaactctaaaaggacaaaagataaggtagtgcctccaaggtggcacctgaaccctctcaggctactttttggtttctactaacaaacctgagggaaggaactgcctccctggcaggatgggcatcaaatcaactctggcttcagatttagttaaaatgaggccgggtgcagcggctcacacctgtcatctcagcactttgggaggccgaggcaggcagatcacaaggtcaggagttcaagaccagcctggccaacatggtgaaaccccatgtctactgaaaatacaaaaattacctggacatggtggcgcgttcctgtaattccagctactcaggaggctgaggcaggagaactgtttgaaccaggacctgggagacggaggttgcagtgagccaagatcacgccactgcactccagcctgggctacagagcaagactccatctcaaaaaaagaaaggcatggattgctagtatttttgaaaggctttatacactacatacggcttttaataaacctttttgcagcaagagggaggaaaagagttttgtttgctttaggaggtagggaaatgtggtaggtgtttcatgcggcctaggaggaggatatgaatgaatggatactatggaatgccagtgatctcgataaggtgggaaccatcctgttcatgttcttttaaggctggttttaagcactatgggtagctgaattttctggctttaagaaaatcatttccattagccaaatatattggccatactataggccttttataattttgttagcaagattatcaggactcaggcaatcaactgtatttcatttctagcttggacagtctggtaattaaatgttgattggacatcagctttgtcaagacacttttacaaagaagtacagtgcatatcctccatcccatagggcttttgggttccaactgcgaagacaacactcttattggccacataggtaggacagtgtaagtaggggtcatgtttatattacagacagcaaaagagaaaagttactgagaactggggcgtttgagaaagttacgtggaggaaagggacaagttgaagacccttaagggcctcacagcctagttaagagaattcataaacaggtgagaagttaaaagtatatcagcaggctaagtattgaaaacaatattaaaggggtaccatgcaaaacacgatgcagcaacaaagaagatatgcaggtaatcatcacattttcttttagaaattcagggaaaaaaagatgtcacataatggcatcaggctcaattggaaagggaaggcttttgaaaataagaggtccggtaagaccttgcctctgggtcactactggtatagggagaaacttgctttaaacagtcctgacataaagtgccttttgacatcaactattcaatacctttgagactcacttagacaactggactcattgtaggttccacagaaaaacacggacaacattctagttgtcactccaaccagccacactaggagggcacagcctctggtaccctttctgttcctgaaggcatgtacagcggcttctacagcaagcttgcttacctcccaggattcacctcatggtttggacactgattcctgagagagccttgagacacacaaagtgaaaaaaatgtcaagcaggaatgaaagctctagttttttgcttgttggtatatgtaaatttgtttaaaaagtatccattctgtcgttggtagaagttttgctttggttgataatagagattctgatgtactcttataacttaggttttctcagaaattaagtagcattgaagatcaatgtaatacagttttaagcaggtacactaattatattattgattctatagaaaactaaaattatagatgaggtatcaggatccattataggttgtaaaaaaattcatgttcttcatagattgagtctaatatttcttctatagattgcatctaatgttcctactacctaaattattacgttcaaagttttgaaaattgaacgaaggtatttttaagtacttaaaacatttctctatcattctgtattacatgtataattataagatattgtttgcttcaactagctgtactttgttttcctgtgaagtttcaacttatgtgttatcgatttaacttaattgttccatctagccatgtataatggaaaaaggaagttaatatttgttattgtgttctatgccagggactgtaccaaactctgattggtacattatttcatgtctcataactctgggatctaagtattgtcacaaagagactaaaaatgagagaaaaaattacttgactaggattatgtaggtggtaataatagaatcaggatttaaactcaggacttcagatgccagcatcaatgatattctctcactggaagtggttctcaaagcaaggtcctgacaaaagcatcagcgttactggggaacttgttagaaaagcaagttcataggctgggcatggtggctcatgcctgtaatcccagcactctaggaggcctaggcaggtgggtcacttgagctcaggagttttgagaccagcctgcacaatgtggtgaaaccctgtctttactaaaagtcaaacaaattagtggtgcattcctgtaggcccagctacacgggaggattgcttgagcccaggagactgaggtgcagtgagccgtgattgctccacttcattctagcctgagcaacggagtgagaccttgtctcaaaaacaaaaaaacaaacaaacaaaaaacaaaaagcaagttcccagaagagaaaaaagaagttccagacctagtgaatcaaaaactctgagcgtggcatctcacaatctgtgtttttgtaatccttccaggtgactgattcatgctaaagtttgagactcattgctctatgccagtcatcattccctttgctcaggttagaatcatctggagagcttataaacgtccccatgcccaggctgcacacagatcaattaaaaggaacctctgagggtgggactcaagcagcagtaaaataaagttcattgagtgattctggtgtgcagccgcagttgaaaatgttatatagcatttaaacaagacactatttaattaaacactatttaaattattaaattacatacattgcttcaggcaaaacaacaacaacaacaacaacaacaaaaacttgggcctttagagcccagcttcctgagcttctgcacgaagtaagtggaacattcatttcttcctgatttgctaaggattgatcaacctccagcaaaatgtatgattagtgagtgtttcagttggtgcatcaattaaatgagaaccaatcatagaacattgaagctaaaaaggaccagagagcttctaggatgaatctgtcttagagatgagaaaaataaaggctcagagagggaagctaacttaactctgatcagacttagtttgttgcagaagtgacctttctgtctcatatttatgtcttgaatatattcactacatgaatacacagactacccattttatcttagtctacttctttcttctctctttgggcctgaataaagaccagaactgatagacagctaaaggatattgcaagcatcattattggaattgggagattccacagaacaatctgagaatgatctcatatcaaatccaatcagatgagttattctgagactaattccaatagttctagagacttttttttttatggtggacattgtttttattgtgtaaataagcaatttttaaagtatatttaaagaaatgaaacataaggaagtgtataggctgtcaggtatgtggggaagtgaagttcatgtagttttcatgtggagcccatacagattttattatagtcaattttagtgaaatttatcgttggtcagatgaaggtttttttccttcattcagcaaataactaatgactgcctactatgtgctaggtgccgaagatagagagataaataacacttagtcactctaagctgaaattgctcagcatatgaaagtggaggaatatttgtaggtgattttgatgttaaagtatttttttaacatcacctggtagtagaagattgagttatgaagctgtctacctctcacctgtaatagttttagagttggttgctattttggtgtaagtcttttttgctgttcctcttttaactgcaaatctttttgagaccagcactcacatccaaaagggcaattgtgataaaaaagaagacagtattttaaggattctgatcagaaccagattcttttcttttcttttttttttttttttttttttttttgagacggagtcttgctctgtcgcctaggctggagtgcagtggcacgatctcagctcactgcaatctctgccgcccgggttcaagcgattctcctgcctcagcctccccagtagttgggattacaggtgtgtgccacaacgcctggctaatttttgtatttttagtagacacggggtttcagcatcttggccaggctggtcttgaattcctgacctcgtgatccacccatctcggcctcccaaagtgcagaaccagattcttaactgccacagactcttgtattatgtaatttatatacagaacacaaagcacttgatttgcttaactgatgtacttgatgatactataaaacctatattatgagaaagcattgctccttcaaaggaatcaagtgatagcaaacactcggtcctgtttccaggttttcctcactgttcattttgcctttgttcttgcagggggagaatgaaaggggcgagagctaaagtgtgttgtcaatgcaagtcaatccttaaccaacaataatttacaaaagaactttatatttgctgtaatcattaaatttagttactaatcccaggaaaagggttagtccttcctcctagtttgtagatttgcaaatggagatgaataattgaatcctattttaatcttttatctgcagtaatctgggcttcttattaccggatatatttgcattttacctccaggccatgttagttcttagaagattattttcctcatgaaccctgttttgttttgcttcctttctgcttcaattctaatgtcacattgcatacctggatgtaaacagcagtcagtttctcagatcaaatagagccctgtagcaacttggaagacacagaagacacacggacataaaactgtatttattatccagggaatgtcactacggattaattatgttaatgaggccatcaaaatctatggtaatctttcaggctttgttgtttgataccagatacagcaaatgagataataatgtgtctaattgtgcctagccagtattggtatttaataaaactttgtcattgaatctttacaa

SEQ ID NO: 188019 - DNA, 1011 bp, Homo sapiens
  Payload ID: 17002
  Gene Symbol: SYCE1
  Gene Name: synaptonemal complex central element protein 1
  ENST ID: ENST00000303903
  CDS Start-End: 55-1011
aatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttga

SEQ ID NO: 188020 - DNA, 1309 bp, Homo sapiens
  Payload ID: 17002
  Gene Symbol: SYCE1
  Gene Name: synaptonemal complex central element protein 1
  Uniprot ID: Q8N0S2
  ENST ID: ENST00000343131
  CDS Start-End: 106-1161
gcattgcgcaggcgcgctgcctggagtcctgcccccagcggcggttgctccaatcaccactggaggctccctcccgaggcaccctcgctggcgagctgagaggaaatggcggggaggtccctgacatcgaaggccgagcccaccgcaggagccgtggacagggctgagaaggccggagggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggccagtcccaagcccctaaaaggagaaagacctggagctgcacaccaagcagggcctgatgtcctcataggccaggaggacacactccaccccgaccttagcccaaggggctttcaggaaataaaggagctattttgatacagctaagtctactggtgaggagtaggggtcaggcccaagatccccagtctcctgtgactgattgaagccttggcttgactctgcctcttggtctgggccagaggtacatcacaggttttcaataaatgcttccttaacctcctgg

SEQ ID NO: 188021 - DNA, 1377 bp, Homo sapiens
  Payload ID: 17002
  Gene Symbol: SYCE1
  Gene Name: synaptonemal complex central element protein 1
  Uniprot ID: Q8N0S2
  ENST ID: ENST00000368517
  CDS Start-End: 140-988
gctcaggctggagaagggccgcgggacccggggaacgcggcctggaggacgaggaggactgggttcccggaggcaacaggaccggctcggcatctacagctactggcaggacacgtcctcacagaaaattgaagacttgatggaaatggtgcaaaagctgcagaaagtgggaagcctagagccccgagttgaggtcctgattaaccggattaatgaggtccagcaagcaaaaaagaaagccaataaagacctaggagaggcccggaccatctgtgaggccctgcagaaggaactggactcgctgcatggagagaaagtacacctgaaggagatcttgagcaaaaaacaagagaccctgaggatcctccggctgcattgccaggaaaaggaaagtgaggcacacaggaagcacaccatgttgcaggagtgcaaggagagaatttctgccctgaacttgcagattgaagaagagaagaacaaacagagacagctgaggttggcattcgaggaacagctggaagatctgatgggccagcacaaggacctctgggacttccacatgccagagcggctggcaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctcctagcagctgctgcccagcgccaccagcagctgcagcagaagtgccaacaacagcagcagaagcggcagaggctgaaggaagagctggaaaagcatggaatgcaagtccctgcccaagcccagagcacacaagaggaagaggctggcccaggagatgtggctcccagaccaggtagaccagtgacatggtggagttgaagagagaggctcactgcagagcactgtttccatggaaaaatggaacatggcaaagtgcagaaattcttcagtcagtccaggacagacgagttctctaagatgcagttaatcatacctgtcttaaacaaactggcaatatactatcaaacatgacttttaaatcaagtggaagttagaaaatatattgaactgagtggcaatgaagacaccacattttaaaactgtaattcagttaagcccacaattagaaggaactttagcttttattggttcaccacaattttttaagaaatcaaccaatgattgttcagttaatgaataaaaggcctttgacacagttcacctattcatgtgaaaaaaaaagactaataaatagtcagcttccctta

SEQ ID NO: 188022 - DNA, 1254 bp, Homo sapiens
  Payload ID: 17002
  Gene Symbol: SYCE1
  Gene Name: synaptonemal complex central element protein 1
  ENST ID: ENST00000432597
  CDS Start-End: 604-978
accccatcctccctgaaacaaggccggaggttgaggaggtctccgcccggccccgcagctgacaaccggtggagaaaccgcacctgccacgggaggggccgcggggtgggctcgagccaccatggggctggtacaagcaccctctccgctcaggacctcggccctcatcccagggcaccagggctcacagggggatgggcccgggtggggacgagggtgtggaggggcaggaagcacggcgggtggagcggagccgggtgcgggggtcgcgggggaccgcggggacggggccttgtgatgcaggagacggagggggctggtgacggaggacgggaggccgcaaggatgggggacgcgacatccttttcccctcccaccggctcaccagggatgcgcctccgcgactgcccgccccaatcccagggcggaggcctcgcgcaaaacccaggcgccgcggctccgcgctccggctgagggtccgcgccgccgcccgcccgctccttcccgctcggccgcggcctcagggacggatactccagcgcgcggttccaaccgaggcccgtggcgggtttagccccatgaagatgaactgggcacccgcgaatggctgggctctgctacaggaggcagccttcctctgcgtgcggccgcggagggctccgcgggggctcgagaggggcctcgagggtgtgtgtgaggccggcgctgtgctatggtgccccgggctcctccctgcgcgtggctgcggccggggcggcgggctcaggctggagaagggccgcgggacccggggaacgcggcctggaggacgaggaggactgggttcccggaggcaacaggaccggctcggcatctacagctactgtacgtggacttcgggcgctggacccacgggcggcctgtgcctctgtgtcgggctgggtggcgccctcagtgccctggggctgctgcggccctaggcctggctgggctcggtgaccacatctggcccccgggccgcaccgtcccccaggatcctccggcctgggctcccccttcctcccttgcccacagtcttggagccccagtgggtgcaggagctgctggctgcccctgtggacccgccatccaccgtcctgcccatgctgcctcgccatccacctgcctgcccacgccgcctcagcctcccacctcccacctagaggagaccatgggccctgccccacctgctccaggatgttagggtcccctcagccaaaaaggcagtggcctgtg

SEQ ID NO: 188023 - DNA, 858 bp, Homo sapiens
  Payload ID: 17003
  Gene Symbol: SYCE1L
  Gene Name: synaptonemal complex central element protein 1-like
  Uniprot ID: A8MT33
  ENST ID: ENST00000378644
  CDS Start-End: 56-784
tttcttttttaaccagtcatcaagcgaggctcgcgcgcaggccccgcgttggaaaatggcggggaagctgaaacctctgaatgtggaggcgccagaagctactgaggaggctgaagggcaagccaagtctttgaagactgaagacttgctggcaatggtgataaagctgcagaaagagggaagcctggagccacagatagaggacctgattagccggattaatgatcttcagcaagcaaagaagaaatccagtgaggaactgagagagacccacagtctctgggaggccctgcatagggaattagactccttgaatggagagaaagtgcacctagaggaggtcttgggcaaaaagcaagaggcactgaggatcctccagatgcactgccaagagaaggaaagcgaggctcagaggttggatgtcagaggacagctggaggatctgatgggccagcacaaggacctctgggaattccacatgctggagcagcgactggcccgggagatccgtgccctggagagaagcaaggagcagctgctctcggagaggaggctggtgcgcgccaagctgcgggaggtggagcggcggctgcactcgccgcctgaggtcgagggcgccatggcggtgaatgacgggctgaaggcggagctggagatattcggggagcaggtccggagcgcccccgaggtcggggccggcgagggagaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatg

SEQ ID NO: 188024 - DNA, 213 bp, Homo sapiens
  Payload ID: 17003
  Gene Symbol: SYCE1L
  Gene Name: synaptonemal complex central element protein 1-like
  ENST ID: ENST00000563157
  CDS Start-End: 1-75
atattcggggagcaggtccggagcgcccccgaggtcggggccggcgagggagagcccccggcaggccggacctgagctcccccgcgctcgcgacgaggaggatcccgagccgccggtggctgcccctgacgccctctaggccagcaggacccgcccgttcccgaccttccctcgagacccgccaagaaataaaggcgatgatttccgaccatg

SEQ ID NO: 188025 - DNA, 1231 bp, Homo sapiens
  Payload ID: 17004
  Gene Symbol: SYCE2
  Gene Name: synaptonemal complex central element protein 2
  Uniprot ID: Q6PIF2
  ENST ID: ENST00000293695
  CDS Start-End: 20-676
gaaggcgggaaaatacggaatggagcgacagggagtggacgtgccccatgtgaaatgcaaagaccaggaaccgcagcccttgggggagagcaaggagcatccgcggtgggaagagaactgcgaggaggaagctggtggagggccagctagtgccagttgccagctgacggtcctggaagggaagtcgggactctacttctcctctctggactcaagcattgacatcctgcagaagagagcccaggagctgatcgaaaacatcaacaagagccggcaaaaggaccatgcactcatgaccaacttcaggaacagcctgaagaccaaggtttcggatctgacagagaaattagaggagaggatctatcagatttataatgaccacaacaagatcatccaggaaaagctccaagagttcacccagaaaatggcaaagatcagccatttggagacagagctcaaacaagtctgccacagcgtggagactgtgtacaaagacctgtgtctccagcctgagcagagcctaagactcagatgggggccagaccactctaggggaaagtccccaccacgtcccggcaactcacagcccccagacgtgttcgtttcttctgtggctgaaactacttctcaggccactgcttcagaagtacagaccaacagagatggtgaatgctgacagctgccgggagactcacgccttagtgacagtctccaggagaagactgtgaggccaccatttgggccacactgagaaattgtttttcatggttctataatgcatcttggcagaaaaaaacaaaaacccaaagctccttgtgctgaactcccaaaatgtagcaagtccagcccctgccataggcccaggcttcgtgctccccacccttggcaagttctccccacccccagccccacagtttattaaatgtttgattttcaacctggccacgcttccttgccacagaggctgaaagcacccctgagctccaaggaaacacagcaagccctttcttaccctcgggagggataggagggacagcacatcggaagagcagtcacttgcctcagctgacctctgcccatctgaagccgcctctcccagagaatcccacaccccatgccctggtgtctcatcctttgctcctccccagctccttgaagcagaaggcagattgtagcctcctttttagagccaattctgtttacttcctaaagtacaaacctatttttttta

SEQ ID NO: 188026 - DNA, 489 bp, Homo sapiens
  Payload ID: 17004
  Gene Symbol: SYCE2
  Gene Name: synaptonemal complex central element protein 2
  ENST ID: ENST00000592819
  CDS Start-End: 1-163
caaagacctgtgtctccagcctgagagcctaagactcagatgggggccagaccactctaggggaaagtccccaccacgtcccggcaactcacagcccccagacgtgttcgtttcttctgtggctgaaactacttctcaggtggttaccagtaaaccggcctgacaccttggggtcagatgtgcaggccactgcttcagaagtacagaccaacagagatggtgaatgctgacagctgccgggagactcacgccttagtgacagtctccaggagaagactgtgaggccaccatttgggccacactgagaaattgtttttcatggttctataatgcatcttggcagaaaaaaacaaaaacccaaagctccttgtgctgaactcccaaaatgtagcaagtccagcccctgccataggcccaggcttcgtgctccccacccttggcaagttctccccacccccagccccacagtttattaaatgtttgattttc

SEQ ID NO: 188027 - DNA, 342 bp, Homo sapiens
  Payload ID: 17005
  Gene Symbol: SYCE3
  Gene Name: synaptonemal complex central element protein 3
  Uniprot ID: A1L190
  ENST ID: ENST00000402753
  CDS Start-End: 28-294
tgcagcttctttctgtgcattgcctagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggaggagatggagaagaactggcaagagctgctgcatgagaccaagcaaaggctgtaggccccactggcccaccacagctgccatgccaccctctgcccgtatgaa

SEQ ID NO: 188028 - DNA, 448 bp, Homo sapiens
  Payload ID: 17005
  Gene Symbol: SYCE3
  Gene Name: synaptonemal complex central element protein 3
  Uniprot ID: A1L190
  ENST ID: ENST00000406915
  CDS Start-End: 49-315
ggccgctgggggcgccagagcaggaccggagcgcgggccaagctggagatggatgatgctgaccctgaggaaagaaactatgacaacatgctgaaaatgctgtcagatctgaataaggacttggaaaagctattagaagagatggagaaaatctcagtgcaggcgacctggatggcctatgacatggtggtgatgcgcaccaaccctacgctggccgagtccatgcgtcggctggaggatgccttcgtcaactgcaaggaggagatggagaagaactggcaagagctgctgcatgagaccaagcaaaggctgtaggccccactggcccaccacagctgccatgccaccctctgcccgtatgaagaggtcactgggggatggagctggcacccacatgaatagctgtatgcactgtacttgtttcttaataaacttatttttaagcaca

SEQ ID NO: 188029 - DNA, 3452 bp, Homo sapiens
  Payload ID: 17006
  Gene Symbol: SYCP1
  Gene Name: synaptonemal complex protein 1
  Uniprot ID: Q15431
  ENST ID: ENST00000369518
  CDS Start-End: 174-3104
caggaacttaagacagttcctcctggcgatgtgatggaatttaatgggacaggagaagggaacgggctttcttttcaggccagcgtggcagcgggcggtagggcgaaagggagaaggaaacgagggtttattccgttgcccactccgcgatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgc

SEQ ID NO: 188030 - DNA, 3522 bp, Homo sapiens
  Payload ID: 17006
  Gene Symbol: SYCP1
  Gene Name: synaptonemal complex protein 1
  Uniprot ID: Q15431
  ENST ID: ENST00000369522
  CDS Start-End: 241-3171
ctgggagcctggcaagcccacacagcgacggttatttagccgttgaactgccagccgcccggggcccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgcaaa

SEQ ID NO: 188031 - DNA, 2554 bp, Homo sapiens
  Payload ID: 17006
  Gene Symbol: SYCP1
  Gene Name: synaptonemal complex protein 1
  ENST ID: ENST00000455987
  CDS Start-End: 179-2554
ccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaa

SEQ ID NO: 188032 - DNA, 3109 bp, Homo sapiens
  Payload ID: 17006
  Gene Symbol: SYCP1
  Gene Name: synaptonemal complex protein 1
  Uniprot ID: Q15431
  ENST ID: ENST00000618516
  CDS Start-End: 179-3109
ccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggagattgaactatccaatctcaaagctgaacttttgtctgttaagaagcaacttgaaatagaaagagaagagaaggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaa

SEQ ID NO: 188033 - DNA, 3034 bp, Homo sapiens
  Payload ID: 17006
  Gene Symbol: SYCP1
  Gene Name: synaptonemal complex protein 1
  ENST ID: ENST00000613524
  CDS Start-End: 179-3034
ccacgcgctccgggccgctcaggctgagcgatttcccgccttttctgaggttctgaggcgggagccattggttctttctgttgccctcatagaccgtatgtagcagttcgcgtgggcacagaacccacggtttcccgctagttcttcaaagtagatatttacaaccgtaacagagaaaatggaaaagcaaaagccctttgcattgttcgtaccaccgagatcaagcagcagtcaggtgtctgcggtgaaacctcagaccctgggaggcgattccactttcttcaagagtttcaacaaatgtactgaagatgattttgagtttccatttgcaaagactaatctctccaaaaatggggaaaacattgattcagatcctgctttacaaaaagttaatttcttgcccgtgcttgagcaggttggtaattctgactgtcactatcaggaaggactaaaagactctgatttggagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaatttggaaatgaaaaagtaagtttgaaattagaagaaggaatacaagaaaataaagatttaataaaagagaataatgccacaaggcatttatgtaatctactcaaagaaacctgtgctagatctgcagaaaagacaaagaaatatgaatatgaacgggaagaaaccaggcaagtttatatggatctaaataataacattgagaaaatgataacagcttttgaggaacttcgtgtgcaagctgagaattccagactggaaatgcattttaagttaaaggaagattatgaaaaaatccaacaccttgaacaagaatacaagaaggaaataaatgacaaggaaaagcaggtatcactactattgatccaaatcactgagaaagaaaataaaatgaaagatttaacatttctgctagaggaatccagagataaagttaatcaattagaggaaaagacaaaattacagagtgaaaacttaaaacaatcaattgagaaacagcatcatttgactaaagaactagaagatattaaagtgtcattacaaagaagtgtgagtactcaaaaggctttagaggaagatttacagatagcaacaaaaacaatttgtcagctaactgaagaaaaagaaactcaaatggaagaatctaataaagctagagctgctcattcgtttgtggttactgaatttgaaactactgtctgcagcttggaagaattattgagaacagaacagcaaagattggaaaaaaatgaagatcaattgaaaatacttaccatggagcttcaaaagaaatcaagtgagctggaagagatgactaagcttacaaataacaaagaagtagaacttgaagaattgaaaaaagtcttgggagaaaaggaaacacttttatatgaaaataaacaatttgagaagattgctgaagaattaaaaggaacagaacaagaactaattggtcttctccaagccagagagaaagaagtacatgatttggaaatacagttaactgccattaccacaagtgaacagtattattcaaaagaggttaaagatctaaaaactgagcttgaaaacgagaagcttaagaatactgaattaacttcacactgcaacaagctttcactagaaaacaaagagctcacacaggaaacaagtgatatgaccctagaactcaagaatcagcaagaagatattaataataacaaaaagcaagaagaaaggatgttgaaacaaatagaaaatcttcaagaaacagaaacccaattaagaaatgaactagaatatgtgagagaagagctaaaacagaaaagagatgaagttaaatgtaaattggacaagagtgaagaaaattgtaacaatttaaggaaacaagttgaaaataaaaacaagtatattgaagaacttcagcaggagaataaggccttgaaaaaaaaaggtacagcagaaagcaagcaactgaatgtttatgagataaaggtcaataaattagagttagaactagaaagtgccaaacagaaatttggagaaatcacagacacctatcagaaagaaattgaggacaaaaagatatcagaagaaaatcttttggaagaggttgagaaagcaaaagtaatagctgatgaagcagtaaaattacagaaagaaattgataagcgatgtcaacataaaatagctgaaatggtagcacttatggaaaaacataagcaccaatatgataagatcattgaagaaagagactcagaattaggactttataagagcaaagaacaagaacagtcatcactgagagcatctttggaaaaactcaaaagagaggcaaaagaaaacacagctactcttaaagaaaaaaaagacaagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttgagcatggtttcagaagaagagacattgaaaacactgtataggaacaataatccaccagcttctcatctttgtgtcaaaacaccaaaaaaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaa

SEQ ID NO: 188034 - DNA, 5567 bp, Homo sapiens
  Payload ID: 17007
  Gene Symbol: SYCP2
  Gene Name: synaptonemal complex protein 2
  Uniprot ID: Q9BX26
  ENST ID: ENST00000357552
  CDS Start-End: 227-4819
tgcggcggtccctgaggcgcagagttgcgacgctcggcggcatagggggcggctccaccgacactacgcggacgcctcctgccgcagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgagagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaattccacgaccactgtttttgcccagacatactccaactaagagtaatactattgtaaatagaaaaaaaataagttctctggtacttacacaagaaacacaaaacagtaacagctattcagatgtaagcagttatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttcagaagttcagtgcatatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaatcattata

SEQ ID NO: 188035 - DNA, 5479 bp, Homo sapiens
  Payload ID: 17007
  Gene Symbol: SYCP2
  Gene Name: synaptonemal complex protein 2
  Uniprot ID: Q9BX26
  ENST ID: ENST00000371001
  CDS Start-End: 140-4732
atacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgagagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaactataaagatctctcaaattcagaatcagagtgtgaacaagaattttcacattcatttaaagagaacataccagtaaaggaggagaatatccattccagaatgaaaacggtaaagctaccaaagaaacaacagaaagtcttctgtgctgaaacagaaaaggaactatcaaaacaatggaaaaactcatctctactaaaagatgctatacgagataattgccttgacttatctcccagatctttatctggcagtccatcatctatagaagtaacgagatgtatagagaaaataacagaaaaggattttactcaggattatgactgcataacaaaatctatatcaccttatccaaaaacttcatcacttgaatccttaaatagtaacagtggagttggaggtacaataaagtcacccaaaaacaatgagaaaaacttcctgtgtgcaagtgaaagttgttcaccaattccacgaccactgtttttgcccagacatactccaactaagagtaatactattgtaaatagaaaaaaaataagttctctggtacttacacaagaaacacaaaacagtaacagctattcagatgtaagcagttatagttcagaagaacggtttatggaaattgaatctccacatatcaatgaaaattatatacaaagcaaaagagaggaaagtcatttagcatcttcattatccaagtctagtgaaggaagagagaaaacgtggtttgacatgccctgtgatgctactcatgtatcaggccccacccaacatcttagtcgcaaaagaatatatatagaagataatctaagtaattccaatgaagtagaaatggaagagaaaggagaaaggagagcaaacttgcttcccaaaaaactgtgtaaaattgaagatgcagatcatcatatccacaaaatgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttcagaagttcagtgcatatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgtctcatgaaagaaatgctaatgtgtgaaatctagtttttatcaccatactttatctaattattattctctgtatataactgaggaaataagaatagtcctacaaagagaaaaatatacatgtcaccgaagcaagtgtaccctttataggaaccctcaaattaaaaaaaaatgtcttttaatggatgagagggaaccactataacatgagtccaagcccagaagacttctgtctatacaatatttttttttaattttggagataaaagctttaagaaactttttgagttaattatactcataaaatgagtttctttaataaattaaattttattgtgtaaaatgtattattacataaaatgtgtttttgaatcaatgcagtttggggatgaatataattaaaatatgtttaataacttagaattcaactaataaaaatttagccacacttacaagggggaggaagtccctagtttaaaatgtataactgagtggtagatcagtactttcagcacactgttggaaacatttattcagatatggctctaatgtattaggaagcactaaatggcctaaaaaagctactacattgcctaaatatgttaattcaatatagaagtcctatttcataaccaggctgtttgacaaatacttttaatctagtagtcattgtaatatcttgctagattaatttataaaaatgagtatacatttgatttgcttttaatgaagttgaaataaatgcttatgtcacttgaataaatataaatcattat

SEQ ID NO: 188036 - DNA, 488 bp, Homo sapiens
  Payload ID: 17007
  Gene Symbol: SYCP2
  Gene Name: synaptonemal complex protein 2
  ENST ID: ENST00000425931
  CDS Start-End: 134-488
tgcggcggtccctgaggcgcagagttgcgacgctcggcggcatagggggcggctccaccgacactacgcggacgcctcctgccgcaggtgtttattttgtcttgctttttttttttttttaaatgaagtcaaaatgccaataagaccagatctccagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatg

SEQ ID NO: 188037 - DNA, 3341 bp, Homo sapiens
  Payload ID: 17007
  Gene Symbol: SYCP2
  Gene Name: synaptonemal complex protein 2
  ENST ID: ENST00000446834
  CDS Start-End: 271-3341
tgcagagttcgcggcgagggtggctcgcgcaggcgcgaggctccccatcagcacctgcctggccagcctcggcctcggggatgggaaatgggcgctcggagccgcccccgcgcgtgggcgactcggtcaagatacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaagattaaatgcagcaaacagtttttccacaaggtggacaaccttatatgcagggaacttaataaagaggatatccacaatgtttcagccattttggtttctgttggaagatgtggcaaaaatatcagtgtattggggcaagctggacttctaacgatgataaaacaaggactaatacaaaagatggttgcctggtttgaaaaatccaaggacattattcagagtcaaggaaattcaaaagatgaagctgttctaaatatgatagaagacttagttgatcttctgctggtcatacatgatgtcagtgatgaaggtaaaaaacaagtagtggaaagtttcgtacctcgcatttgttccctggttattgactcaagagtgaatatttgtattcagcaagagattataaaaaaaatgaatgctatgcttgacaaaatgcctcaagatgcccggaaaatactctctaaccaagaaatgttaattctcatgagtagtatgggagaaaggattttagatgctggagattatgacttacaggtaggcattgtagaagctttgtgtagaatgaccacagaaaaacaaagacaagaactggcacatcagtggttttcaatggattttattgctaaggcatttaaaagaattaaggactctgaatttgaaacagattgcaggatatttctcaaccttgtaaatggcatgcttggagacaaaagaagggtctttacatttccttgtttatcagcatttcttgataaatatgagctgcaaataccatcagatgaaaaacttgaggaattttggattgattttaatcttgggagtcagactctctcattctacattgctggagataatgatgatcatcaatgggaagcagttactgtgccagaggaaaaagtacaaatatacagcattgaagtgagagaatcaaagaagctactgacaataattctgaaaaatacagtaaaaattagcaaaagagaagggaaagaattgcttttgtattttgacgcatcactagaaatcactaatgtaactcaaaaaatttttggtgcaactaaacatagggaatctatcagaaaacaaggtatttcagttgccaaaacgtcgctgcatatactttttgacgcaagtggatcacagattctagtgccagaaagtcaaatctcaccagtcggagaagagctcgttagtttaaaggaaaaatcaaagtccccaaaggaatttgctaaaccttcaaaatatatcaaaaacagtgacaaagggaatagaaataatagtcagcttgagaaaactactcctagcaaaagaaaaatgtctgaagcatcaatgattgtttctggtgcagatagatacactatgagaagtccagtgcttttcagcaacacatcaataccaccacgaagaagaagaattaaaccaccactgcaaatgacgagctctgcagagaaacctagtgtttctcaaacatcagaaaatagagtggataatgctgcatcactgaaatctagatcatcagaaggaagacatagaagagataatatagacaaacatatcaaaactgctaagtgtgtagaaaacacagaaaataagaatgttgaattcccaaaccaaaattttagtgaactccaggatgttataccagattcacaggcagcggaaaaaagagatcatactatattacctggtgttttagacaacatctgtggaaataaaatacacagcaaatgggcatgttggacacctgtaacaaacattgaactatgtaataaccaaagagcaagtacttcgtcaggagacacattgaatcaagatattgttataaataaaaaacttactaaacaaaaatcatcctcttcaatatctgatcataattctgaaggaacaggaaaagtgaaatataagaaagaacaaaccgaccatatcaaaatagataaagcagaagtagaagtttgcaagaaacacaatcagcaacaaaatcatcctaaatattcagggcagaaaaatactgaaaatgccaagcagagtgattggcctgttgaatctgaaactacttttaaatcggttctcctaaataagacaattgaagaatcgctgatatataggaagaaatacatattgtcaaaagatgtgaatactgctacttgcgataaaaatccatctgctagcaaaaatgtgcaaagtcatagaaaagcagagaaagaattgacttctgagcttaattcctgggattcgaaacaaaaaaaaatgagagaaaagtcaaaagggaaagaatttaccaatgtagcagaatccttgataagccaaatcaataaaagatacaaaacaaaagatgacatcaagtctacaagaaaattaaaggagtctttgattaacagtggtttttcaaacaaacctgttgtacaactcagtaaggaaaaagttcagaaaaaaagctacagaaaactgaagactacctttgttaatgttacttctgaatgcccagtgaatgatgtttacaattttaatttgaatggagctgatgaccctatcataaaacttggaatccaagagtttcaagctacagctaaagaagcttgtgcggataggtcaattagattggtaggtccaaggaatcatgatgaacttaaatcttctgtcaaaacaaaagataaaaaaattataacaaatcatcaaaagaaaaatctgtttagtgatactgaaacagagtacagatgtgatgacagcaagactgatattagctggctaagagaaccgaaatcaaaaccacagctaatagactatagcagaaataaaaatgtgaagaatcataaaagtggaaaatcaagatcatccttggaaaagggacagccaagctctaaaatgacacccagtaaaaatatcacaaaaaagatggacaagacaattccggaaggaagaatcagacttccacgaaaagcaaccaaaacaaaaaaaaa

SEQ ID NO: 188038 - DNA, 625 bp, Homo sapiens
  Payload ID: 17007
  Gene Symbol: SYCP2
  Gene Name: synaptonemal complex protein 2
  ENST ID: ENST00000412613
  CDS Start-End: 1-625
gagaaaacgtggtttgacatgccctgtgatgctactcatgtatcagtgtctgaaagtgtatcttcattatcaacaaatgacttttctattccttgggagacctggcaaaatgaatttgcagggatagagatgacttatgagacttacgagaggctcaattcagaatttaagagaaggaataatatccgacataaaatgttgagttattttactacgcagtcttggaaaacagctcagcaacatctgagaacaatgaatcatcaaagtcaggactctaggattaaaaaacttgataaattccaattcattatcatagaggagctggagaattttgaaaaagattcacagtctttaaaagatttggaaaaggaatttgtggacttttgggaaaagatatttcagaagttcagtgcatatcaaaaaagcgaacaacagaggcttcatcttttgaaaacttcattggctaaaagtgtcttctgtaatactgatagtgaagaaactgtttttacatccgagatgtgtttgatgaaagaagatatgaaagtgctgcaagacaggcttcttaaggacatgctagaagaggagcttcttaatgtacgcagagaactgatgtcagtattcatgt

SEQ ID NO: 188039 - DNA, 3130 bp, Homo sapiens
  Payload ID: 17008
  Gene Symbol: SYCP2L
  Gene Name: synaptonemal complex protein 2-like
  Uniprot ID: Q5T4T6
  ENST ID: ENST00000283141
  CDS Start-End: 297-2735
gagtgctggctttctcttaaagggtgagtgcgtgcgcccaggtggtttggcctgtgtgcgctagttacttgcacgcgcttcttgagtctcaaaacacagagctctagtaaacttcagggggcggattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcgaaaaacaaagatgctttgcagcctattaaggaagacaggactgggaaggcccaggatgatgctttctggcttcaatcacttattacggatgcattccatgataaaggatttcagaaaataaaagaatactttcaacagaaagagagccactttcctcaaaaatataatcgtcttctattataccgtcttgacagatcaataaataaggaactagataaaaatgaatttcagtctgtgtcactgttgctgaaatgtattcagcgattcctcgtagatggcctgaaagaagatgaacctctgctaattcggcagggactgatcccaaagctagtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgaaagaccttgcaaggacactcttgactgtgggtgattatgaccagcaggttgctatttctgaagcgctgtgtagactgacgattaaaaaatcaagggatgaacttgtccataaatggtttgatgatgaagtcattgctgaagctttcaaagaaattaaggatcgagaatttgagacggacagtagacgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctccgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgttaaacaacttggagtggtgttgctttttttttataaaagtaaaatggacttttttttgtttgagaaatgtcttcaagttttgtgtgaataaaacactttagcagcatctgtataaa

SEQ ID NO: 188040 - DNA, 3069 bp, Homo sapiens
  Payload ID: 17008
  Gene Symbol: SYCP2L
  Gene Name: synaptonemal complex protein 2-like
  Uniprot ID: Q5T4T6
  ENST ID: ENST00000341041
  CDS Start-End: 297-1172
gagtgctggctttctcttaaagggtgagtgcgtgcgcccaggtggtttggcctgtgtgcgctagttacttgcacgcgcttcttgagtctcaaaacacagagctctagtaaacttcagggggcggattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcgaaaaacaaagatgctttgcagcctattaaggaagacaggactgggaaggcccaggatgatgctttctggcttcaatcacttattacggatgcattccatgataaaggatttcagaaaataaaagaatactttcaacagaaagagagccactttcctcaaaaatataatcgtcttctattataccgtcttgacagatcaataaataaggaactagataaaaatgaatttcagtctgtgtcactgttgctgaaatgtattcagcgattcctcgtagatggcctgaaagaagatgaacctctgctaattcggcagggactgatcccaaagctagtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgaaagaccttgcaaggacactcttgactgtgggtgattatgaccagcaggttgctatttctgaagcgctgtgtagactgacgattaaaaaatcaagggatgaacttgtccataaatggtttgatgatgaagtcattgctgaagctttcaaagaaattaaggatcgagaatttgagacggacagtagacgttttctcaatcacctaaacaacagacttggtgaccaaagaagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagactttccctggagtgatgagtaaaatgtccggcaagattagtattttggggagatcatggaggcttactctagaccagcactgtcctatagaaatatgagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctccgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataagaaagccaaagcctggttttatgattgcagccctcagcctgggctgcctgaagacgaagagaaagagcaaggttattgttggctcaggccttgttagccagacttcgtgctctgtacgcattcaatttcctcccctccaaacatcatccctgggaactgctgagttcagatagaatatatgttggtagtttgcagttgggttattatccatttgttcataaaaattaaccttttgtattaaaatttggtcagatagtattaatagaaagttcaggatgtt

SEQ ID NO: 188041 - DNA, 644 bp, Homo sapiens
  Payload ID: 17008
  Gene Symbol: SYCP2L
  Gene Name: synaptonemal complex protein 2-like
  ENST ID: ENST00000487561
  CDS Start-End: 1-330
gtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgacagtagacgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccatttt

SEQ ID NO: 188042 - DNA, 2436 bp, Homo sapiens
  Payload ID: 17008
  Gene Symbol: SYCP2L
  Gene Name: synaptonemal complex protein 2-like
  ENST ID: ENST00000543878
  CDS Start-End: 1-2436
acacagaaaaacaaagatgctttgcagcctattaaggaagacaggactgggaaggcccaggatgatgctttctggcttcaatcacttattacggatgcattccatgataaaggatttcagaaaataaaagaatactttcaacagaaagagagccactttcctcaaaaatataatcgtcttctattataccgtcttgacagatcaataaataaggaactagataaaaatgaatttcagtctgtgtcactgttgctgaaatgtattcagcgattcctcgtagatggcctgaaagaagatgaacctctgctaattcggcagggactgatcccaaagctagtttcctggtttgaaagaacaacaggaattctgacctcggaaggcctagcctcagacacgtcgctgatttgtgttatagaagatttctttgacactgcattgattatttccaggagtagtagtgaagggaaaattcagatgttggattccttcctacttagcttaggattcctggtgacagaaaagactgtaaatcatttgcttcaacaggagggcttgaagacttttaactgcattttgcacgctgtccctcgagaagagagaaaaaaattccctttgtcagaaggcatgtgtcatcttatgaaagaccttgcaaggacactcttgactgtgggtgattatgaccagcaggttgctatttctgaagcgctgtgtagactgacgattaaaaaatcaagggatgaacttgtccataaatggtttgatgatgaagtcattgctgaagctttcaaagaaattaaggatcgagaatttgagacggacagtagacgttttctcaatcacctaaacaacagacttggtgaccaaagaagggtgtattcatttccgtgtattgctgcttttgctgatgagcatgagatgagaaaaccagcggatgaaaaattagagaaattttggatcgacttcaacctaggaagtcagagtgtcactttttatatagacaatgctgagaatactctatgggactcagtgacacttccgaaggaagcggtgatgaatttcagcataacagaaacggagaagataaagatatttatcatttacctgaagaagcccatgattatcagctacaaagaagtcatgaaaatagaaatccattttgatttgcagttcaacatatcacaagtttccattcaagctttaggagaagacaaacagatgttgcctgaccagacgaaaatctcctcagaactttttagtaagtctgataaagaagacagggagagtcccagtggccttgaaagagaaacagagcaggcagaagaatccactaacatggtggagtttatgagtgctgaagatgaccgctgcctaataactctccacttaaatgaccaatctgagccacctgttattggggaacctgcctctgatagtcaccttcagccggtccctccgttcggggtccctgacttcccgcaacaacctaagtctcattacagaaaacatctcttctctgagagtaatcaagattcaagtaccagtgaactatcttggaccagtaaccagaaaaagaaatccctaaaatcatattccagtagaaagaagacaagaaccagaagtaatttgagaatcttgccagttttccctcccagtagtggcagtggccatgagaaagaccaagctaagcttctatcaccatcagagaaagaaatacccgagcaaaataacaccacatctccaaagacttctgaacaaaaattccaagatagttttgcttttttgactgctgaagattctgcccagaaaacagagcttcaagatcctcactcactgagtgagctctcttccttgaagcactcagaagatgaagaaaaacctaagattgtgaaccaagaatcactaacagaaagtactagcttgaaacataagctgagaaacttggaagacaaagacataccagaaggtagttttgctaagtcacaacaatcaagattggaagaagaggttgctccgggatcccctttctcaataacagaagaaagagagttgccagaaggaatttccacttcatccctagaagttgtgccagagaacttgaacggttctgccattctcccaacctttgaaaacttcactaaaaaacggaaaagaaaatatgagcttaggtacagaaagcgtccgtttaattcagaaaatgcaaagaaagcaccggattgcctaataaaacttttaaaccagatgcaactgttcagactcaataaactagagcgctttcaaaatttggttcttcaagagttgagcagtcttaagcaggatattcaggccctggaacaccttgagaaggaggttctggaattctgggggaaacagtctgctgatctgcaatctttctgtgatctgcaagtgctgaggttcaattcaactcagacttcataa

SEQ ID NO: 188043 - DNA, 1068 bp, Homo sapiens
  Payload ID: 17009
  Gene Symbol: SYCP3
  Gene Name: synaptonemal complex protein 3
  Uniprot ID: Q8IZU3
  ENST ID: ENST00000266743
  CDS Start-End: 79-789
cgcgcttgtggaggagttgtggaggacgcctgtcgacgaccagtaactggtcctcggccattgcggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacgatttaatttta

SEQ ID NO: 188044 - DNA, 845 bp, Homo sapiens
  Payload ID: 17009
  Gene Symbol: SYCP3
  Gene Name: synaptonemal complex protein 3
  Uniprot ID: Q8IZU3
  ENST ID: ENST00000392924
  CDS Start-End: 81-791
gagttgtggaggacgcctgtcgacgaccagtaactggtcctcggccattgcggtgtgtttcagtcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgtt

SEQ ID NO: 188045 - DNA, 1120 bp, Homo sapiens
  Payload ID: 17009
  Gene Symbol: SYCP3
  Gene Name: synaptonemal complex protein 3
  Uniprot ID: Q8IZU3
  ENST ID: ENST00000392927
  CDS Start-End: 133-843
ttgcctcagaagcgtcgcggagaaggggccacctcaggtgaagcgcgcttgtggaggagttgtggaggacgcctgtcgacgaccagtaactggtcctcggccattgcggtgtgtttcaggaagcatctaaatatggtgtcctccggaaaaaagtattccaggaaatctgggaagccgtctgtggaagatcagtttacgagagcctatgactttgagactgaagataagaaagatctgagtggatcagaggaagatgttattgaagggaagactgcagtcattgagaaacgtaggaagaaaaggtcttctgcaggagtagttgaagatatggggggtgaagtgcagaatatgctggaaggagttggagttgacattaacaaggctcttcttgccaagagaaagagactagaaatgtataccaaggcttctctcaaaactagtaaccagaaaattgaacatgtttggaaaacacaacaagatcaaaggcagaagcttaaccaagaatattctcagcagtttctgactttgtttcagcagtgggatttagatatgcagaaagctgaggaacaagaagaaaaaatacttaatatgtttcgacagcaacaaaagattcttcaacaatctagaattgttcagagccagagattgaaaacaattaaacagttatatgagcagttcataaagagtatggaagagttggagaagaatcatgataatctacttactggtgcacaaaatgaatttaaaaaagaaatggctatgttgcaaaaaaaaattatgatggaaactcagcagcaagagatagcaagtgttcggaagtctcttcaatccatgttattctgatgactctttgaagaaagaacttgaacctaagtaatatgatacaattataacgttagctaagaagcatattgtaagtctttagaatagtttaattgtaacatctttaatcataaacctgtttcattgtaagacctccctttctgttaagtcaaatctaaatagttatgagttagttagcaactattcctaaagaatatgtattaagctttcagctctttagtaatgatagtgaatttttctctctaacactgtcaattaaataaagacgatttaattt

SEQ ID NO: 188046 - DNA, 2498 bp, Homo sapiens
  Payload ID: 17010
  Gene Symbol: SYP
  Gene Name: synaptophysin
  Uniprot ID: P08247
  ENST ID: ENST00000263233
  CDS Start-End: 74-1015
aacgagcgcgcgccgcccccgccgcgccccgcgccgcccttgctagccgagcctcccgccccctgcattgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccacctagtctacccggc

SEQ ID NO: 188047 - DNA, 858 bp, Homo sapiens
  Payload ID: 17010
  Gene Symbol: SYP
  Gene Name: synaptophysin
  ENST ID: ENST00000376303
  CDS Start-End: 8-130
attgctgatgctgctgctggcggacatggacgtggtgaatcagctggtggctgggggtcagttccgggtggtcaaggagcccctcggctttgtgaaggtgctgcaatgggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggg

SEQ ID NO: 188048 - DNA, 1850 bp, Homo sapiens
  Payload ID: 17010
  Gene Symbol: SYP
  Gene Name: synaptophysin
  Uniprot ID: P08247
  ENST ID: ENST00000479808
  CDS Start-End: 14-955
ccctgcattgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtgagtgaccggcgagcggtgcggccaaggagggtacaaggaaggagacgagcgggtcagtgaaccaataagagtcaggggtagagagtacgtaaggcgtttactggggcaagtaaggactgaagtttgaaggagccaatcaagaggcagaactacctgctaagagctgaaaaactagctaatgaatggagaaaagaagaatggtgcttcaagatggacagaatgaagagccaatgggagggaggtagaagggcaactcggcggaaaggcggggggagagaagcagagcaaccaataaagggagggaatatcgggggacttgcgcagtggcgaatcagcggagcgcaagagccacggaagcgacgaggaggtgggtcttagaagtgactgataagccaataggtgataaggccaatagatggtgagggtaaatgggcgtggatcttgaaggtcagacgagctcaccaatccgggaggaggggatagatctgccgcctctccccaacgctggaggggagggaagtagtgtggaatttcaaaggaggaagagggatagggtggggtcctggaaaggtttgccggccttcttgctgggccttaaaagagaagtgagggtcggggcttggtggctcatgcctgtaatctcagcactttgggagaccgaggcgggcgggccgcttgagcccaagagttcgagaccagcctgggcaacatgatgaaatcccacctctacaaaaaatacaaaaattagccgggcgtggtggcatgcatctgtggacccatctactcaggaggctgaagtgggaggatcacttaagcccaggaggttgaggctgccgtgagctatgatcctgccactgcactccagcctgggcaacagagcgagacctt

SEQ ID NO: 188049 - DNA, 761 bp, Homo sapiens
  Payload ID: 17010
  Gene Symbol: SYP
  Gene Name: synaptophysin
  ENST ID: ENST00000472598
  CDS Start-End: 1-611
tggcggacatggacgtggtgaatcagctggtggctgggggtcagttccgggtggtcaaggagcccctcggctttgtgaaggtgctgcaatgggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaata

SEQ ID NO: 188050 - DNA, 581 bp, Homo sapiens
  Payload ID: 17010
  Gene Symbol: SYP
  Gene Name: synaptophysin
  ENST ID: ENST00000469389
  CDS Start-End: 8-364
attgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggtgtgctcccaccctgggataccaacagacctgggagaggaaggggcagggtggaaccggccaatacctccccccgcaagtagctcctgcccagctcccacctcgaggctacatccactgggatcactgagcacctgccttgtacctggcactgctctggactctaggactatgtggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccg

SEQ ID NO: 188051 - DNA, 513 bp, Homo sapiens
  Payload ID: 17010
  Gene Symbol: SYP
  Gene Name: synaptophysin
  ENST ID: ENST00000466635
  CDS Start-End: 8-364
attgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggtgtgctcccaccctgggataccaacagacctgggagaggaaggggcagggtggaaccggccaatacctccccccgcaagtagctcctgcccagctcccacctcgaggctacatccactgggatcactgagcacctgccttgtacctggcactgctctggactctaggactatgtggtgagcaaggcagacataggctgtggccctctggctctgttccagcgaaggggctgcaccaagtgtactttgatgcacccacctgccgagggggcaccaccaa

SEQ ID NO: 188052 - DNA, 2127 bp, Homo sapiens
  Payload ID: 17011
  Gene Symbol: SYPL1
  Gene Name: synaptophysin-like 1
  Uniprot ID: Q16563
  ENST ID: ENST00000011473
  CDS Start-End: 48-827
gagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 188053 - DNA, 2151 bp, Homo sapiens
  Payload ID: 17011
  Gene Symbol: SYPL1
  Gene Name: synaptophysin-like 1
  Uniprot ID: Q16563
  ENST ID: ENST00000455385
  CDS Start-End: 124-849
gcctccgagcccggccagcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaga

SEQ ID NO: 188054 - DNA, 1017 bp, Homo sapiens
  Payload ID: 17011
  Gene Symbol: SYPL1
  Gene Name: synaptophysin-like 1
  ENST ID: ENST00000464029
  CDS Start-End: 1-446
taaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatggagtttcgctatgtcgctcagactggagtgcagtggcatgatctcggcacactgcaacctccgcctcctgggttcaagtgattctcctacctcagcctcccaggtagctgggattacagatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacaga

SEQ ID NO: 188055 - DNA, 1193 bp, Homo sapiens
  Payload ID: 17011
  Gene Symbol: SYPL1
  Gene Name: synaptophysin-like 1
  ENST ID: ENST00000470347
  CDS Start-End: 14-688
ctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatggagtttcgctatgtcgctcagactggagtgcagtggcatgatctcggcacactgcaacctccgcctcctgggttcaagtgattctcctacctcagcctcccagatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagt

SEQ ID NO: 188056 - DNA, 835 bp, Homo sapiens
  Payload ID: 17011
  Gene Symbol: SYPL1
  Gene Name: synaptophysin-like 1
  ENST ID: ENST00000634737
  CDS Start-End: 1-408
tggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgataaatggaaatggactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaa

SEQ ID NO: 188057 - DNA, 3624 bp, Homo sapiens
  Payload ID: 17012
  Gene Symbol: SYPL2
  Gene Name: synaptophysin-like 2
  Uniprot ID: Q5VXT5
  ENST ID: ENST00000369872
  CDS Start-End: 217-1035
gcggccgcagcctctgagagcacgaacagcagcgcccccgcgtcccagccagccagccagccagactggactccggcccaccgacggccgctcgcgctccggccccgctcgcctgctctgccccggacctgcagctccccgctcccccgccgtgtccgccgcctcccggccagagagccaagccaccacgccgcgcccagcgctcgccgcgccagcatgtcctcgaccgagagcgccggccgcacggcggacaagtcgccgcgccagcaggtggaccgcctactcgtggggctgcgctggcggcggctggaggagccgctgggcttcatcaaagttctccagtggctctttgctattttcgccttcgggtcctgtggctcctacagcggggagacaggagcaatggttcgctgcaacaacgaagccaaggacgtgagctccatcatcgttgcatttggctatcccttcaggttgcaccggatccaatatgagatgcccctctgcgatgaagagtccagctccaagaccatgcacctcatgggggacttctctgcacccgccgagttcttcgtgacccttggcatcttttccttcttctataccatggctgccctagttatctacctgcgcttccacaacctctacacagagaacaaacgcttcccgctggtggacttctgtgtgactgtctccttcaccttcttctggctggtagctgcagctgcctggggcaagggcctgaccgatgtcaagggggccacacgaccatccagcttgacagcagccatgtcagtgtgccatggagaggaagcagtgtgcagtgccggggccacgccctctatgggcctggccaacatctccgtgctctttggctttatcaacttcttcctgtgggccgggaactgttggtttgtgttcaaggagaccccgtggcatggacagggccagggccaggaccaggaccaggaccaggaccagggccagggtcccagccaggagagtgcagctgagcagggagcagtggagaagcagtaagcagccccccacctggctattcccgaactggacagcacctcttcaaccacctccggcttccaggacctttctcttcctcctcctccaattcccctcccccatcattctggtctttgagctttgagacgatgggcaggcatcagctgttggaaacctgggcagccctctcagtggcttcctatcctccttcttgctggagccatgaatggcaggagctcagtgcttcttgtgcagtgcctggacccaggtatcttacttggggtcttacttgtacccttacagtctctgagaaccagcctctgctgcaggtgagggttgggggcaggaaaccagtgctctgagactggttcctagcagccacctttctgtcaacctgtccggcttcaacaatattagggggaagggaaatcagctagtagccttcccctctggtcccttgtgtggaggccccaatagtggtttggcgacccctcctcagtggctgtcatctagtccctgcgtctgatctccagtcatcccatgactcagtgtgccttccactgtcttctctggcctctgcctgcccacagaatccaccatgtgtgaaccagagaggtccaccagcctagaaaacagcccttcagagggtcctgatgaggccttcctggactcagctgggagcaagataaattgcaactgagttgcagcttcaagaaagtaaagccagtaagcttgctggcagaatcaatttcttctatcccctcaatcctcccacccaccaggctggggcactttccaccaacactctaaactctactttagaaacgccctatcttcctccctgtcctccttcttggtctcacacttgggactcaaaaatgtggagtcaggacctgcctcctaatccccttacttctctgtccatctcccttccccagcatcgtgcatctgaggcatttgagatcctttttgaagtctgtccaggccttccttttattcctgtggggccagacaggggcttaggaagggccaaaggaccatcatgaggctaagttgccccagagccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgggacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccgaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctcccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaagga

SEQ ID NO: 188058 - DNA, 5374 bp, Homo sapiens
  Payload ID: 17013
  Gene Symbol: SYNPO
  Gene Name: synaptopodin
  Uniprot ID: Q8N3V7
  ENST ID: ENST00000307662
  CDS Start-End: 530-3241
ctgataaagagctgggctgagtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcacacacacacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcattcttctgcctcctg

SEQ ID NO: 188059 - DNA, 7063 bp, Homo sapiens
  Payload ID: 17013
  Gene Symbol: SYNPO
  Gene Name: synaptopodin
  Uniprot ID: Q8N3V7
  ENST ID: ENST00000394243
  CDS Start-End: 375-3164
agagcgcgagtgaggagcaggcgggcaggcggcgggcagccgggcagccgtggacagaggcccgggcacagccagttgctgtgccagagggtgtggtgtccggctacagattgccccaaagcggcctcacaccagagacgggttaagaagagggattggaggtccaccactccactagcccaggaaggacttatctttcgtctcagccagacctcaccccaattctgtgaatcagcggaggaaggcaaaagtgcagagagtcagaggaggctgtgtaaggagcagagaccagggctcacacagctggccccagcccaggccctggcccaggcccaggagcctgcttccctgcatcgctgaggaagaacagcaccatgctgggtcctcacctcccacctccgccccttgcacccagcgaagggaggcctaccccctgcgccttccagatccctgatggaagctacaggtgtctggctctggaagccgaggagagcagcggtgaggagggcctgcagggagaggtggggcctaccgacctggaagaggatgagggggtcagcaggagtggggacgactctgcctgcagagtcacccaggggacaccgcagctgcccaaagccctgggcatccaaccacccagctgctccagagaggaacaaggggcgtcccagcacgacgacagggccagccaggactgggatgtagtgaaggccgggcagatgatgacagccagccccagccctggccctgggcccagagtggcccagaaaccagcgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaatccgtcttgcttctttctttcttccgtgctgctaggggtcagggttcccttcctcctgcctgattctagcctgggaagtggagtgggcctgctcaattactgtgtgtgaaagtgtggctgtgtcctgcgtgctgcctgcacctgccgtgtgtctggttctgcactggtacagacgtgtgctgggttggaaatgagggcttcctctctacagcactcagggagccagaaccctgtgcaaatcgcaaccttttgttctttccttccctcagagtttggccaaaaatactttagaggatttttggggaaaatgcactacctcttctcgttgaggtttgtttgggttctttacaagtggaatagaaattcctctagccagcattcgctctccagttccctcaggtcccctccctgctccccattatctaaatttggccatttcccacatttgccattgttttcactgtctggatcctaaaagcatggagtttctgcccctggtggggaggaaagaactgccatcaagggtcaggagagctgggttctagccccaggtctgcatctgattcgtgtgtgacctcagacaacctcttccaatctctgggcctcagtttccccttctgtgcagtgaaaggattacagaaggaggtcagagaccatttggtctccgacagtccaggtttgactgtgttctacttatgtattcaccccacacatgtgccctgctttgggtctggggttgggttgagtggatgctactttttgaattttcacccaccgcattcccaaggagctctggtgtgcacggtgcattgagctctctgtcagaaagtgaacagttctgatttcctgcagccttttcgtactgtgcacacccccgactcaaaaacatacacacagagtcagtgcccaggcatggctgttagggtgaggtcaggctctggcccatctccagatgatggggatctgcttaccactgccctcaacattcaatcccgtttgagcccttctgttttgtagtcttggctgaattgttatttcttccacttgttggcctcagcattccccttgtggccaccaaaggcagaaacaatgctttagagatttttaggtagttatcatagctctcctgtgcagcctactctcctggctgaagaccccaggttccgctgccttgggtggttattgactggcttgggtcatgaactctaggccctacctccctgctcagggtggcactgtggtcaggtgttgggtcatgccagagcccaccctgatttggcatttggccctagccctcctcttctagccctggagctgggaccttcctcccagctcctctccctaaactgtggggtctgccttctgcggccagcctgactgggatgttccactggcacagagaagctcccagtgtctctggctcatgtatacacaattctgaccctgggaagaaaacagtgggatcccaggctgagccttaactttcagcttgatgactgggagcttggatgtccctagggagtctctaagggtcactccagcattagtatcccatgaaaaatgtcctgctcaggctgttgtataacattcttctttaggttaaagggctccagtttggagtctgggctcatctagcagctgctacattctgtttggataaaacatacaattggtgtctatttcctttggattgggaggaattagaagactctcagttggatgagaggatgactggcttggttatggctgatcactgattggatgaaagaataaatctttggatggttctagattttgatcgggtaggaagcatggaatggactggctagctctgaactctggtggatgactgctagtgaatttggattggattaaatggcaaggtggactggtta

SEQ ID NO: 188060 - DNA, 5098 bp, Homo sapiens
  Payload ID: 17013
  Gene Symbol: SYNPO
  Gene Name: synaptopodin
  Uniprot ID: Q8N3V7
  ENST ID: ENST00000522122
  CDS Start-End: 308-3097
agtttgcatcttaggtcacaccactcctgtgattcctgtggtattgccccaaagcggcctcacaccagagacgggttaagaagagggattggaggtccaccactccactagcccaggaaggacttatctttcgtctcagccagacctcaccccaattctgtgaatcagcggaggaaggcaaaagtgcagagagtcagaggaggctgtgtaaggagcagagaccagggctcacacagctggccccagcccaggccctggcccaggcccaggagcctgcttccctgcatcgctgaggaagaacagcaccatgctgggtcctcacctcccacctccgccccttgcacccagcgaagggaggcctaccccctgcgccttccagatccctgatggaagctacaggtgtctggctctggaagccgaggagagcagcggtgaggagggcctgcagggagaggtggggcctaccgacctggaagaggatgagggggtcagcaggagtggggacgactctgcctgcagagtcacccaggggacaccgcagctgcccaaagccctgggcatccaaccacccagctgctccagagaggaacaaggggcgtcccagcacgacgacagggccagccaggactgggatgtagtgaaggccgggcagatgatgacagccagccccagccctggccctgggcccagagtggcccagaaaccagcgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctc

SEQ ID NO: 188061 - DNA, 4571 bp, Homo sapiens
  Payload ID: 17013
  Gene Symbol: SYNPO
  Gene Name: synaptopodin
  Uniprot ID: Q8N3V7
  ENST ID: ENST00000519664
  CDS Start-End: 510-2567
gtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaa

SEQ ID NO: 188062 - DNA, 7295 bp, Homo sapiens
  Payload ID: 17014
  Gene Symbol: SYNPO2
  Gene Name: synaptopodin 2
  Uniprot ID: Q9UMS6
  ENST ID: ENST00000307142
  CDS Start-End: 197-3982
gagcccattagccgcacaaattcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagttagaagaacggatcatgtgccaactgtagttttttaaaaaaaacgctcctttgtagggttttaaacttttctaatagatttagattcacttttggtcttggcttgttctcataagtcatttatctaagtttgtgtttctgtgtgtgtgtgtgtgtgtgtatgtatgtgaatatacacacacacacacacacaggtgagtgtgaatacttccttgttggctgatccatagagcattacttggaagaaaatttcactatttgcattgatgtgctggcatttatatgtaattcataattttgattccattaataggtagtctatgcaacaaactctactcaattaaagtaaaactaagtatttcttcattgtaccttagtccaggaagaaattaatggaatatggtgtgctaattatcactacctataacatgaggaatataacattgcagaaatttctcataggggcatgccagtgagcaattactttataaaaatattttccttggtgttaagtatttctctgcaacttttttttttttttttttttttttttgagatggagtcttgctctgtcccacccagtctggagtgcaatggtgcgatcttggctcactgcaacctgcgcctcctgggttcaagcaattctcctgcctcagcctcctgagtagctgggattacaggcatgaaccaccacacctggataatttttgtatttttagtagacacaaagtttcaccatgttggtcagactggtcttgaactcctgacctcgtgatctgcccgcctcagcctcccaaagtgctgggattacaggcgtgagccaccacacctggcctttctgcaacatttttttaaaaaaatctaataaatcttagatttttaaaaaagaattaaaatgtgggagttctcagaaagaaataaacacatgagaataagattattacacattttggaaggacttttgaggaatgatgtgatgtgtagagaatagaaagatttagatatatgcctgtgacaggaatagattctgggttcaggggtccccatctgtcaaatgagaagattggattatctaatcttttagatccttaacaactctgatattctgagattctctcatttgtagaatgcccgctgatgcattgtttattttttttgctcataatataaatatcagattatgtttaggagtggattaggtaattagtgtcactacatgtatcattaaaggtcctaaaaggaattgttaggcggcaggctttgtgttacgtgttacatggagtgagggtagatgtgaagatttaaaacgattgatggatttaaggaagtggtacataaatatgtctgttattatgcaatcgtaggtcatgataatttattcagttatagaaaacatgccacagaagcctatgtaacaagtggtgcttctttagaaagttgtcattagaatgttctgaggaagttaagcagctgcttcatcaatcccatgacacatgccttgttagcatgcccatcaaataatcagatcaaacacctgctccttattgccatacccacgaactgttaaatataaaaaaattcaaagtatttgacatcttaagcaaatatccagaatatttttaagtaaaaaaccatcttaagtattcaaaatttccttggttttttaaaggtgataattttgctttgtgttacttttttgctcttgaatgtatcgttatgatggtctcttataatcatggtatctttcacagaataaaaattaaaaataatgccagggtgcaagtgaccaaggccttatcttgaaagttaaaaaaaaaaagtaaagaaatcacagtaagttctattagtgatgatagaaccagatataaaattgttcagtgatggagaaaagaaacgataaatactttccaaggttatattgttaaattatcttaaattatcaaggtgtaagatgtaatgatcccaagagtttttatagaatcctaaaaaataacgcctgatgtatagattagttagcaaattctcagaaatcccccacataaaagccttactttgttcaaaatttattatagtggtttaatcattttagatttgaatgttttaagataggagagacttagcagaaaatacttggcttgccagggccacgttctacttcattgctttcttttataagtgcaaggagttatttccatcagttgacatagatattattcactaaaattttcagcagactcaaaatagagaggagactttaaacttacatgttagcataaaacagacttctctctcattgcatgcactagatcaatattatcatctgtattaagctatctgaatttattcgagacattaagaaaaagacagtacatggtgggaaagctgcacatttctcacaaggaaaaaaacattctatatttgtagcagaaatcagtggtttgaaaagtcatactttgcagatatgaacctgaaaatcaaagtgccattgttaaatcatcctaaagtgtactgtgggtattctccagcatacttgaaaatgaataaagttagattgctcacattgaagctaatggttgagacaagacacctgccagagtgaagtttgattcctatgggtgagaagatgtagatgactattgttctcactaaagttctaaaataatagcaagtgtagagaagagccgttgctttgaaaatacataccacatttgttataaagcatttgtttgttagtatcaatcacataggtagaaagagtttgagttttactgtggattaaaaagccttccctaaaaagagagcatgccagtcatagagacactaatttggcacttttcctccttcttaggtttaaatgttataccaatgcatgtgtttgaaatatccattaagatgatttaaaatttgtcttgtattttgagtttcttaaatgcgtggattcttgttcatttatctctgaatatgtctcttttatattttggcacaattatacacattggaaagggccaacctattagggctcaagtatgtatatgcaaaaaaaaaaagttatatcaaacaggcacagttattacaactagagagaaattccagaaatatttgtttttttaagagaaagtaaattttcacattagatttctattcaaagtactaatatctacatggtccacacttttctattttaaaaaattgtgttctcttgttaaatagattaacatttccacttctgtttatcacaaaagactgtatttgaaatatgcatacggaaaattgaaattatattagtaataaatgtaacttgaaaaatcaa

SEQ ID NO: 188063 - DNA, 3588 bp, Homo sapiens
  Payload ID: 17014
  Gene Symbol: SYNPO2
  Gene Name: synaptopodin 2
  Uniprot ID: Q9UMS6
  ENST ID: ENST00000434046
  CDS Start-End: 1-3330
atgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttgaaaaaaaaaattcacattctaagaataaacagaaaaatgttcttcttggaagtaaataacaaaa

SEQ ID NO: 188064 - DNA, 9920 bp, Homo sapiens
  Payload ID: 17014
  Gene Symbol: SYNPO2
  Gene Name: synaptopodin 2
  Uniprot ID: Q9UMS6
  ENST ID: ENST00000429713
  CDS Start-End: 183-3464
cacaaattcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggtgtggaaaccatctgttgtggaagagtaatcttgtagctgaagctgagtgtccactttgcttgaaatgaattgtttgcagtgtttcttgagtccctgagaatgcctagcaaagtcctcaacttacttaatttcagatatgtcacctcctaatctgggtccaaggagtataatatttttaatgagtcaaaaatccaactcagattgacctaaaatatatttatcttctttgcacacttaaaaaatccaggagcaccccaaaatagacatgtaccgttatattaagtaagcaggagacttaggatttgtgctgtagccacaagaaagacagtgatcagtgatatcaaacatcaggaatcagcctttatgtaacataacagctgtcctcctatggtgaaaggttcaaatgtagtgaaggtataacctatattgactgagatttcccttttaggtagtgccttatctctattactagtgttaaaggaataaggaatctatgaaggacagggagcagctctggtctgtcaatctcagccacctgtttgatatcacagagaagatactcggaggattgttggaatgtatatagtttagtaagaagtgggtaagaaagagggtcttaattactgagcacttattatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacctggagaaaccacatgattgggacctgaaggtttactgactgactacaggggctgattgtgaagcacgaggaaccccatgtgtgtggagactgtagggtgagagcacacaattattagcatcatttctgagtgatctcacagattttttttcttgtgtttgctttgctttttgacaactgcttctcccacgttccttgcaattctattctctcaccttcactttactatttgtattcgatggaccaggataattcaggcaaggttaccttgtaaactttaattggccacacaccatgttgtcacccagctggctatgaagtgaataatggtactgaaagtaaacctgaagacctttctcagatctattttaagtctgagtctgaccaaccatggaaaatattcgacatgaattaatgtagagaactataaagcatttatgacagctccaagaaaaatcatctactctatgcaggagatatgtttagagacctctcagaaaaacttgcctggtttgagggtacacagtaccattttaatcttctgaaaatatctgtattcctgctctttttctgctgtcactgtcaatctgctatatttttcactatcctattaaaatattactgtctcctttatctgttcaatgtccatattttaaaaaaatcttccttgtatgagctattctgatctaaataatttctctgatatttctctatatggctcccacaacaatttcattgttgttagcatatctatttctccatacattgtaaaactgtaatccttaggtatttctaaaacataaagaggagaattaagtcagctgcagaacaatggggctgattcttctgctttttctctggaaaatctttcattgcttttggtggaaatttacctagaggttacaaccacaggatgtagcttggtctcttatttgcctttttgggaaaccaattaagattaatacaggataaaggaaaaaagcaatctattcattatataacacagttgtttgtattacttgttccctgcaaaggaaatctgttgaatgcttgcattttgaattcttttctaatagaacaaccaaaaaaggcttcttatggtgcagcaggaaaaaagatcatttttatagctttgcattcttaacatagcatttaaagagcggcatgaattagaggaaagacatggaacacacaggtagtcggtttgagatcatcggcttaaaagtatcctaggatggtaatgacccagaagtatttccagttgtctagtggtgtggtatgcaggaatgagaagtgttttctttccatttcctgttggacaggtggcaatcttagcagagccactatttggagttgataactaaagatgcaaataacatgactatgccttctggtcatcctaggactatttggagttctccaaaaccttgtaagaggcatgtcaggcatgcagtaaaagcatctacaacttcagctgggcactggcagcataggtctcatcttggaccatacagtcccactttatagaagagggtggaagttctccaaaacaatatccacaacaaagtctgacctcactctgagggagatgggaagtgggaggaagaaggactaaccagctccctggagtaagaggaatttgctttccctgtctgcccaccaggggctatatgtgccacctttcaggttggggccaaggaagtgatgtcagtgtgacagaagggagagttagacctccagacgtcagcctccctcccatggggtacattttcaatctgagtgttgttgccttagctgtgttggtattagcttgattggttggtccgctggttatgaggtgtagggaggcagtttttgtttagtttttaggactttgcctcttcctttgtccttagcataatttctaggcagagcatccacgaagtcggttttcattgccagctcaagagcgacaatcatttacgagttcctatgttatgttaggtgccttatgtatattatcccaaatccactgcatggtttaaatacaggcactggaatataaatgaaaaaggtcattacagtcactgactttctgcaggaccttaaacatttctctttccacaagtttccccttaatcatgtgtcaaacctctcttcctgacgggaatgttgtgctataatgaatctgcataacgcttgggattctaggaggaaggaaggttccatggacatgtaagtacagcatattcccctcagtcttctaggagggcagagtgaatcccagaactggtaagattgggaatctgagcattgccactttaatcttagaatatttatcattttgacacatcctgttttttagagaggaaaacaaacacagtttctgcattggtagtgtaaagcataccttgttaggaacgtgttttgtaagacacatttgggttgtcactctagagcatgtcaaactttgtacttcaaaatatatttagtatgattgttagtggtaacatatatcaaggctttgaattaactgttttatttaattttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaaaacacctgatctacattgaaagggggtagactaacgtatgtgagaccattttcctatttgcagttacaaggttaaagaactttgaaggtcattcggctgctaagaggcatgtcgaacactctgtgtggctctttcacagtaaaccctcctaagagcagaagacacatggctgttagtgtctgcgtttagatttaatttctcaaataaaggcccttggctgcgtatcatttcatccagttataaactagggctcctgcaagcacccccattctaagggtgaattattgaaatcagttgctatttgatgagtcacaactggcccagcaggcagggcatttgaagtcatggtcatcaaaaagaaatgattgttttttgaaaagctaaatgcttaaaatgcttctagagggaagtcgtggggcgtgtgctcattctctttaaaatcagggttgttgagtttgtttttaaacatttttataagttcatgagaaaaaatatataaattctaagaaccaacactgtattcccagaaacatgaccctcgctggtcttgggtccacatatcattggactctgggggacacaaagatgcctgtgacactttggtgttgccgagttagtcaacaattattctgggaaaaagcagaattgaattcttctctagatgtcctaccagggttggccaagggccacaaagcaggctaataaattcccacaggatccagacaccaggcaaaattgctctaagaagccagttactgtcatccctctatggttctagaaaaaatagtacaaaaatgacaggtcatcctatgagcgtcatgccaatgaaaccccatcttctggagaagcccttgaatcagaattatcttttttcttgatgtcgtcagatgcagccagtttcttaatttttttaaaaactgtatgtttctgtggtatgtatatttgtacacctaactacctggcacttggaaatcacagcactactcagaggcaattgaataaagagaaatttaattttaaatatcaagtcctgtcaaacatttctcaaacttctgattttatcaaaggtttgccagccaataaagtgcatcccaagtatacaggggagaaagctagactcctacagggtcctagagtttaagtaatttttttgttattaatataggtaataatttttctaatttttattttttggttccaaatgtaaagctccttgtgtttacctctgtttatgtcattcttgacatgtttatctaaattatgtgtgctctgtgacaggtgaaatgtaaatctgggatccatagtcaagatatcataaggacctacttcccagcctacctttcttcctctacctgataatgataatactcaaaataacaacattcaaaggaaacacaaagaaatcctgctttcacatctcctatttcttgggctccttaataactactgatggtttgttcatgaaaaaaaatttttaaatcaaaagattgtacttggccctgagttgaaaaaatttcaaaaatcaaaagtttgtacttggccctgagttgaaaaaaaaaattcacattctaagaataaacagaaaaatgttcttcttggaagtaaataacaaaagccatagtgttttcatttgtcttttcttcaggatacacggtagaagtcagagaatctttgatacttttatttggtgcaataatcaaggccatgcaacaacccaaaatcaagcattttggttcaagtcaggatgacatgagtggggacagaagctgtggcagtcattcaaataatctcatgggtcctgaggaaaagacaggagttaatgtattaagtttctactatatgcaggaactgtgttaaatattttacataagttttgataatagctaacattagctgagcacaaaatttgggccctgatttgtgctgagtatctttcacagattactgcttttaatcagcagtccttgtgagctaggtatgatcattatccccattttatagattacagatgagattctgaggcacaaagaggctaagtaacttgccaaagatcatacgatgttaagtaatggcccctggattcagtctgcagcctgaattcttaaccaattatactgtgatttcattattcttcagaattacactaaaaagaaggtattattcccattttacagatgaggtatctaagctcagagaagctaaacaacttgtgcaacaatcactaagcttataagcagtggattagggttagatttagatatttgtctggcatccaaacctgtgctctccctacagtaccacatggtttccacagtctcatcagaccccggaatttcactccctgagactgcttaattgtgaatttcccaaactgattcaccaagagcctactgtctctgctttgtagatagctttgaccacattcaatgacattaggaaagactccatttcccaagatggctcagaaaatcagatgctatgacgcatgttgaaagtgaaaacccatctctgagaaagaagcatctgttttattagtaaaaaaaaaaaatgaaatttacagcaatgttgtgtgacttctcaaaattctttcattttcttatttcagaatgaatagtgttgttcgttggctgggaatggggaagaatgtgatttttaaaaataaagcataatcaaactctgc

SEQ ID NO: 188065 - DNA, 4298 bp, Homo sapiens
  Payload ID: 17014
  Gene Symbol: SYNPO2
  Gene Name: synaptopodin 2
  ENST ID: ENST00000448416
  CDS Start-End: 197-568
gagcccattagccgcacaaattcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagttagaagaacggatcatgtgccaactgtagttttttaaaaaaaacgctcctttgtagggttttaaacttttctaatagatttagattcacttttggtcttggcttgttctcataagtcatttatctaagtttgtgtttctgtgtgtgtgtgtgtgtgtgtatgtatgtgaatatacacacacacacacacacaggtgagtgtgaatacttccttgttggctgatccatagagcattacttggaagaaaatttcactatttgcattgatgtgctggcatttatatgtaattcataattttgattccattaataggtagtctatgcaacaaactctactcaattaaagtaaaactaagtatttcttcattgtaccttagtccaggaagaaattaatggaatatggtgtgctaattatcactacctataacatgaggaatataacattgcagaaatttctcataggggcatgccagtgagcaattactttataaaaatattttccttggtgttaagtatttctctgcaacttttttttttttttttttttttttttgagatggagtcttgctctgtcccacccagtctggagtgcaatggtgcgatcttggctcactgcaacctgcgcctcctgggttcaagcaattctcctgcctcagcctcctgagtagctgggattacaggcatgaaccaccacacctggataatttttgtatttttagtagacacaaagtttcaccatgttggtcagactggtcttgaactcctgacctcgtgatctgcccgcctcagcctcccaaagtgctgggattacaggcgtgagccaccacacctggcctttctgcaacatttttttaaaaaaatctaataaatcttagatttttaaaaaagaattaaaatgtgggagttctcagaaagaaataaacacatgagaataagattattacacattttggaaggacttttgaggaatgatgtgatgtgtagagaatagaaagatttagatatatgcctgtgacaggaatagattctgggttcaggggtccccatctgtcaaatgagaagattggattatctaatcttttagatccttaacaactctgatattctgagattctctcatttgtagaatgcccgctgatgcattgtttattttttttgctcataatataaatatcagattatgtttaggagtggattaggtaattagtgtcactacatgtatcattaaaggtcctaaaaggaattgttaggcggcaggctttgtgttacgtgttacatggagtgagggtagatgtgaagatttaaaacgattgatggatttaaggaagtggtacataaatatgtctgttattatgcaatcgtaggtcatgataatttattcagttatagaaaacatgccacagaagcctatgtaacaagtggtgcttctttagaaagttgtcattagaatgttctgaggaagttaagcagctgcttcatcaatcccatgacacatgccttgttagcatgcccatcaaataatcagatcaaacacctgctccttattgccatacccacgaactgttaaatataaaaaaattcaaagtatttgacatcttaagcaaatatccagaatatttttaagtaaaaaaccatcttaagtattcaaaatttccttggttttttaaaggtgataattttgctttgtgttacttttttgctcttgaatgtatcgttatgatggtctcttataatcatggtatctttcacagaataaaaattaaaaataatgccagggtgcaagtgaccaaggccttatcttgaaagttaaaaaaaaaaagtaaagaaatcacagtaagttctattagtgatgatagaaccagatataaaattgttcagtgatggagaaaagaaacgataaatactttccaaggttatattgttaaattatcttaaattatcaaggtgtaagatgtaatgatcccaagagtttttatagaatcctaaaaaataacgcctgatgtatagattagttagcaaattctcagaaatcccccacataaaagccttactttgttcaaaatttattatagtggtttaatcattttagatttgaatgttttaagataggagagacttagcagaaaatacttggcttgccagggccacgttctacttcattgctttcttttataagtgcaaggagttatttccatcagttgacatagatattattcactaaaattttcagcagactcaaaatagagaggagactttaaacttacatgttagcataaaacagacttctctctcattgcatgcactagatcaatattatcatctgtattaagctatctgaatttattcgagacattaagaaaaagacagtacatggtgggaaagctgcacatttctcacaaggaaaaaaacattctatatttgtagcagaaatcagtggtttgaaaagtcatactttgcagatatgaacctgaaaatcaaagtgccattgttaaatcatcctaaagtgtactgtgggtattctccagcatacttgaaaatgaataaagttagattgctcacattgaagctaatggttgagacaagacacctgccagagtgaagtttgattcctatgggtgagaagatgtagatgactattgttctcactaaagttctaaaataatagcaagtgtagagaagagccgttgctttgaaaatacataccacatttgttataaagcatttgtttgttagtatcaatcacataggtagaaagagtttgagttttactgtggattaaaaagccttccctaaaaagagagcatgccagtcatagagacactaatttggcacttttcctccttcttaggtttaaatgttataccaatgcatgtgtttgaaatatccattaagatgatttaaaatttgtcttgtattttgagtttcttaaatgcgtggattcttgttcatttatctctgaatatgtctcttttatattttggcacaattatacacattggaaagggccaacctattagggctcaagtatgtatatgcaaaaaaaaaaagttatatcaaacaggcacagttattacaactagagagaaattccagaaatatttgtttttttaagagaaagtaaattttcacattagatttctattcaaagtactaatatctacatggtccacacttttctattttaaaaaattgtgttctcttgttaaatagattaacatttccacttctgtttatcacaaaagactgtatttgaaatatgcatacggaaaattgaaattatattagtaataaatgtaacttgaaaaatc

SEQ ID NO: 188066 - DNA, 6779 bp, Homo sapiens
  Payload ID: 17014
  Gene Symbol: SYNPO2
  Gene Name: synaptopodin 2
  ENST ID: ENST00000504178
  CDS Start-End: 1-3466
gggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagttagaagaacggatcatgtgccaactgtagttttttaaaaaaaacgctcctttgtagggttttaaacttttctaatagatttagattcacttttggtcttggcttgttctcataagtcatttatctaagtttgtgtttctgtgtgtgtgtgtgtgtgtgtatgtatgtgaatatacacacacacacacacacaggtgagtgtgaatacttccttgttggctgatccatagagcattacttggaagaaaatttcactatttgcattgatgtgctggcatttatatgtaattcataattttgattccattaataggtagtctatgcaacaaactctactcaattaaagtaaaactaagtatttcttcattgtaccttagtccaggaagaaattaatggaatatggtgtgctaattatcactacctataacatgaggaatataacattgcagaaatttctcataggggcatgccagtgagcaattactttataaaaatattttccttggtgttaagtatttctctgcaacttttttttttttttttttttttttttgagatggagtcttgctctgtcccacccagtctggagtgcaatggtgcgatcttggctcactgcaacctgcgcctcctgggttcaagcaattctcctgcctcagcctcctgagtagctgggattacaggcatgaaccaccacacctggataatttttgtatttttagtagacacaaagtttcaccatgttggtcagactggtcttgaactcctgacctcgtgatctgcccgcctcagcctcccaaagtgctgggattacaggcgtgagccaccacacctggcctttctgcaacatttttttaaaaaaatctaataaatcttagatttttaaaaaagaattaaaatgtgggagttctcagaaagaaataaacacatgagaataagattattacacattttggaaggacttttgaggaatgatgtgatgtgtagagaatagaaagatttagatatatgcctgtgacaggaatagattctgggttcaggggtccccatctgtcaaatgagaagattggattatctaatcttttagatccttaacaactctgatattctgagattctctcatttgtagaatgcccgctgatgcattgtttattttttttgctcataatataaatatcagattatgtttaggagtggattaggtaattagtgtcactacatgtatcattaaaggtcctaaaaggaattgttaggcggcaggctttgtgttacgtgttacatggagtgagggtagatgtgaagatttaaaacgattgatggatttaaggaagtggtacataaatatgtctgttattatgcaatcgtaggtcatgataatttattcagttatagaaaacatgccacagaagcctatgtaacaagtggtgcttctttagaaagttgtcattagaatgttctgaggaagttaagcagctgcttcatcaatcccatgacacatgccttgttagcatgcccatcaaataatcagatcaaacacctgctccttattgccatacccacgaactgttaaatataaaaaaattcaaagtatttgacatcttaagcaaatatccagaatatttttaagtaaaaaaccatcttaagtattcaaaatttccttggttttttaaaggtgataattttgctttgtgttacttttttgctcttgaatgtatcgttatgatggtctcttataatcatggtatctttcacagaataaaaattaaaaataatgccagggtgcaagtgaccaaggccttatcttgaaagttaaaaaaaaaaagtaaagaaatcacagtaagttctattagtgatgatagaaccagatataaaattgttcagtgatggagaaaagaaacgataaatactttccaaggttatattgttaaattatcttaaattatcaaggtgtaagatgtaatgatcccaagagtttttatagaatcctaaaaaataacgcctgatgtatagattagttagcaaattctcagaaatcccccacataaaagccttactttgttcaaaatttattatagtggtttaatcattttagatttgaatgttttaagataggagagacttagcagaaaatacttggcttgccagggccacgttctacttcattgctttcttttataagtgcaaggagttatttccatcagttgacatagatattattcactaaaattttcagcagactcaaaatagagaggagactttaaacttacatgttagcataaaacagacttctctctcattgcatgcactagatcaatattatcatctgtattaagctatctgaatttattcgagacattaagaaaaagacagtacatggtgggaaagctgcacatttctcacaaggaaaaaaacattctatatttgtagcagaaatcagtggtttgaaaagtcatactttgcagatatgaacctgaaaatcaaagtgccattgttaaatcatcctaaagtgtactgtgggtattctccagcatacttgaaaatgaataaagttagattgctcacattgaagctaatggttgagacaagacacctgccagagtgaagtttgattcctatgggtgagaagatgtagatgactattgttctcactaaagttctaaaataatagcaagtgtagagaagagccgttgctttgaaaatacataccacatttgttataaagcatttgtttgttagtatcaatcacataggtagaaagagtttgagttttactgtggattaaaaagccttccctaaaaagagagcatgccagtcatagagacactaatttggcacttttcctccttcttaggtttaaatgttataccaatgcatgtgtttgaaatatccattaagatgatttaaaatttgtcttgtattttgagtttcttaaatgcgtggattcttgttcatttatctctgaatatgtctcttttatattttggcacaattatacacattggaaagggccaacctattagggctcaagtatgtatatgcaaaaaaaaaaagttatatcaaacaggcacagttattacaactagagagaaattccagaaatatttgtttttttaagagaaagtaaattttcacattagatttctattcaaagtactaatatctacatggtccacacttttctattttaaaaaattgtgttctcttgttaaatagattaacatttccacttctgtttatcacaaaagactgtatttgaaatatgcatacggaaaattgaaattatattagtaataaatgtaacttgaaaaatcaa

SEQ ID NO: 188067 - DNA, 3934 bp, Homo sapiens
  Payload ID: 17014
  Gene Symbol: SYNPO2
  Gene Name: synaptopodin 2
  Uniprot ID: Q9UMS6
  ENST ID: ENST00000610556
  CDS Start-End: 242-3934
atttgttgccttcaaaatattcagaacatgttgctctggagctcaggagagaaggtgaagtaaagatctgaattcggcaactcggaagcgaagctccaatcttgaggatggatcagattggtgagggagactgtcatatagagtgagaagagagatccaaggacagaactgcaggaagcatcaatatttgaggaatgagaaaggaagaaaagcctcccacaaaagagatgagacaagaggaatggttacacagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccaaccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtgggacatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtggcaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatga

SEQ ID NO: 188068 - DNA, 4121 bp, Homo sapiens
  Payload ID: 17015
  Gene Symbol: SYNPO2L
  Gene Name: synaptopodin 2-like
  Uniprot ID: Q9H987
  ENST ID: ENST00000372873
  CDS Start-End: 23-2284
agccaacaccgcctttctcagcatggagacctttgagcccatcagccaagagcccctcagccaagccagctatgacaaagccccagacccagttcctgagctccaagactcgttctatgcagaactgcaacgtgcagagagcctccaagagaagagcataaaagaggccaagaccaaatgcaggacaattgcatccctgctcactgcagcccccaacccccactccaaaggggtacttatgtttaagaaacggcggcagagagccaagaagtacaccctggtgagcttcggggctgctgctgggacaggcgctgaggaggaggacggcgttccccccacgagtgagtccgagctggacgaagaagccttctctgacgcccgcagcctcaccaatcaatctgactgggacagtccctatctggacatggagcttgccagggcgggctcaagagcatcagagggccagggctctgggctgggagggcagctgagtgaggtctctgggcgaggggtgcagctctttgaacagcagcgccagcgcgcagactccagcacccaggaactggcacgggtcgaaccagcagccatgctcaacggggaaggcctgcagtcaccacctcgggcccagagtgctcccccagaggcagctgtgctcccacccagccccttgccggcgcctgtagccagccccagacccttccaaccaggtggtggagccccgaccccagctccaagcatctttaaccggtcagccaggccctttaccccgggcctacaagggcagcggccaactaccacctcggttattttccggcctttagcccccaaaagggcgaacgacagcctggggggcctcagccccgccccaccccccttcttgtcttcgcaggggcccacccctctgcccagcttcacttcaggggttcccagccacgcgccagtctctggttcccccagcaccccacgctcctcgggccctgtgacagccaccagctccctgtacatcccagcccctagtcggcctgtcaccccaggtggagctccagagccccccgctcctcctagcgcagctgccatgacctccaccgcttctatcttcctatctgcgcctttgcgaccctctgcgcgcccagaggcgcctgccccaggcccaggggctcctgagccccccagcgctcgcgagcagcgcatctctgtgccagctgcccgcacgggtatcctgcaggaggcccggcgccgggggacccggaagcagatgttccggccgggaaaggaggagacgaagaactcgcccaaccccgagctgctatcgctggtacagaacctggatgaaaagcctcgggccgggggtgcagaatctggtcctgaagaagatgctctgagcctcggggctgaagcctgcaacttcatgcagccagtaggggccaggagttacaagaccctgcctcacgtgacacctaagaccccccctccaatggctcccaagaccccgccccctatgactcctaagactccacccccagtggctcctaagcccccatctcgagggctccttgatgggctcgtgaatggggcagcctcttcggctggaatccctgagccaccaaggctgcagggcaggggtggggagctgtttgctaagcggcagagccgtgcggacaggtatgtggtggaaggtacacctggtcctggtcttggccctcggcctagaagtccttctcctaccccgtctctgcccccttcctggaaatattcacccaacatccgtgccccgcctcctattgcttacaacccactgctctctccctttttcccccaggcggcccgaactctccctaaggcccaatcccaggggcctcgggcaacacccaagcagggcatcaaggctctagattttatgcggcatcagccctatcaacttaaaactgccatgttctgttttgatgaggttcccccgactcctggccctatcgcctcagggtcccccaaaactgcccgagtccaggagattcgccggttttccactccggcaccccagcccactgcagaacccctggctcccactgtgcttgccccccgagcagccactacactggatgagcccatctggagaacagaactggcctcagcccctgttcctagcccagcccctcctccagaggctcccaggggccttggggcttctcccagctcctgcggtttccaggtagccaggccccgattttcagccaccagaacaggattgcaagctcatgtgtggaggcctggggcagggcaccagtgaacaggcacaggtcccaggaccaaggagaggtggaacatccagttcctaaagttgcttctcctaccctatcccatcccctgtcacgcatctggaagctaaattgcctcctgccagagatggtttccaagttgatgtccccttcccccaccttcctcctcactctctacctccctgccgctttccaaccaagtatgtctgctttggtatctttgcctctctttgtctctgcatttcctttcctggatctctgtctttatttccaggcttctccacccatattcctccacagatctctcttccttgacatttgtgcttttctccctgggcctcattttaatgttcagtgagaagtaaacagagcagaagtgaccactgggacttcaggcaagaagctcaccaccaggcacacagcaaagggactgaactgacccctgtttgcactaagccacccccaccccccactctgctttcccaagcttgactggcatatacctaggcctgtgtgtgtgtgtgtgtgtgtgtgtgtgtgtgtgtgtgtgctcttccgtctaaggcatgaataagaggggaggtcaaaataaagacccaatctgaggccgggcacggtggctcacgccggtaatcccagcactttgggaggccgaggcgggcggatcacgaggtcaggagatcgagaccatcctggctaacacggtgaaaccccatttccactaaaaatacaaaaaattagctgggcgtggtggcgagcgcctgtagtcccagctactcgggaggctgaggcaggagaatggcatgaacctggaaggcggagcttgcagtgagctgagattgcgccactgcactccagcctgggcgacggagcgagactctgtctcaaaacaaacaaacaaacaaaagacccaatctgagtcttatcgttgtactgatagaagggtcagatatccccacatggagttgagtgggagaaagagattcactagagaataactccttagagaccaatgtctgtagcaggtgtacagcatcttgtgaaagttatggagcatgaaaagactgaagggccaggacagtttgcatgggctgagttataccagctagaccaggaatagaacaaagaattctatacctcaggatttcaaaaagttagcaacttgagaggccagtgctgagcaacccagtacccaggaaatgaaaaaaagaaagaaaattccctccgagaatgaacaaatcattggcttcattgcctcatgagcttgagagaaaggagaagagagccagagtgtggcaagtgaggccaaaatcagaagcatggcagaaatgagtgtaagtgattgagccacagacagaagtgtggcgagggacaatgccatattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttc

SEQ ID NO: 188069 - DNA, 4921 bp, Homo sapiens
  Payload ID: 17015
  Gene Symbol: SYNPO2L
  Gene Name: synaptopodin 2-like
  Uniprot ID: Q9H987
  ENST ID: ENST00000394810
  CDS Start-End: 151-3084
gttgcctgcctgtggtgtgtggtgtgggggggaggcctggggcagcaggagcaggacagccggacaggaagcccagacggggttcgagcacctcaacttctctcctggggacactgttcaaactccgggggccataggccaagctgagcgatgggtgctgaggaggaggtgctggtcacactatcagggggagccccctggggcttccgacttcatgggggggccgagcagaggaaaccgttacaggtgtctaagattcgaagacggagccaggctggcagagcaggactccgagagagggaccagctcttggcaatcaatggggtctcttgcaccaacctctcccatgccagtgccatgagcctcatcgatgcctcaggaaatcagcttgtcctcactgtgcagcggttagcagacgagggtcctgtgcaatctccatctccccatgagcttcaggtgctgtcacccttatctccactaagtcctgagccccctggtgctccagttcctcagcctcttcagcctgggagccttcgttcacctcctgatagtgaggcttactacggagagactgacagtgatgctgatggccctgccacccaggagaagccccgtcgacctcgccgccgaggccccacaaggcccacccctccgggtgccccacctgatgaggtctacctgtctgacagccctgcagagccagcacctactatccctggccctcccagccagggtgacagccgtgtgagctccccgtcttgggaggatggggcagcccttcagccacccccagctgaggctctgctgttaccccatggccccctccgacctggtcctcatctcatccctatggtggggcctgttccccacccagtggcagaagatcttactaccacctacacccagaaggccaagcaagccaaactgcaacgtgcagagagcctccaagagaagagcataaaagaggccaagaccaaatgcaggacaattgcatccctgctcactgcagcccccaacccccactccaaaggggtacttatgtttaagaaacggcggcagagagccaagaagtacaccctggtgagcttcggggctgctgctgggacaggcgctgaggaggaggacggcgttccccccacgagtgagtccgagctggacgaagaagccttctctgacgcccgcagcctcaccaatcaatctgactgggacagtccctatctggacatggagcttgccagggcgggctcaagagcatcagagggccagggctctgggctgggagggcagctgagtgaggtctctgggcgaggggtgcagctctttgaacagcagcgccagcgcgcagactccagcacccaggaactggcacgggtcgaaccagcagccatgctcaacggggaaggcctgcagtcaccacctcgggcccagagtgctcccccagaggcagctgtgctcccacccagccccttgccggcgcctgtagccagccccagacccttccaaccaggtggtggagccccgaccccagctccaagcatctttaaccggtcagccaggccctttaccccgggcctacaagggcagcggccaactaccacctcggttattttccggcctttagcccccaaaagggcgaacgacagcctggggggcctcagccccgccccaccccccttcttgtcttcgcaggggcccacccctctgcccagcttcacttcaggggttcccagccacgcgccagtctctggttcccccagcaccccacgctcctcgggccctgtgacagccaccagctccctgtacatcccagcccctagtcggcctgtcaccccaggtggagctccagagccccccgctcctcctagcgcagctgccatgacctccaccgcttctatcttcctatctgcgcctttgcgaccctctgcgcgcccagaggcgcctgccccaggcccaggggctcctgagccccccagcgctcgcgagcagcgcatctctgtgccagctgcccgcacgggtatcctgcaggaggcccggcgccgggggacccggaagcagatgttccggccgggaaaggaggagacgaagaactcgcccaaccccgagctgctatcgctggtacagaacctggatgaaaagcctcgggccgggggtgcagaatctggtcctgaagaagatgctctgagcctcggggctgaagcctgcaacttcatgcagccagtaggggccaggagttacaagaccctgcctcacgtgacacctaagaccccccctccaatggctcccaagaccccgccccctatgactcctaagactccacccccagtggctcctaagcccccatctcgagggctccttgatgggctcgtgaatggggcagcctcttcggctggaatccctgagccaccaaggctgcagggcaggggtggggagctgtttgctaagcggcagagccgtgcggacaggtatgtggtggaaggtacacctggtcctggtcttggccctcggcctagaagtccttctcctaccccgtctctgcccccttcctggaaatattcacccaacatccgtgccccgcctcctattgcttacaacccactgctctctccctttttcccccaggcggcccgaactctccctaaggcccaatcccaggggcctcgggcaacacccaagcagggcatcaaggctctagattttatgcggcatcagccctatcaacttaaaactgccatgttctgttttgatgaggttcccccgactcctggccctatcgcctcagggtcccccaaaactgcccgagtccaggagattcgccggttttccactccggcaccccagcccactgcagaacccctggctcccactgtgcttgccccccgagcagccactacactggatgagcccatctggagaacagaactggcctcagcccctgttcctagcccagcccctcctccagaggctcccaggggccttggggcttctcccagctcctgcggtttccaggtagccaggccccgattttcagccaccagaacaggattgcaagctcatgtgtggaggcctggggcagggcaccagtgaacaggcacaggtcccaggaccaaggagaggtggaacatccagttcctaaagttgcttctcctaccctatcccatcccctgtcacgcatctggaagctaaattgcctcctgccagagatggtttccaagttgatgtccccttcccccaccttcctcctcactctctacctccctgccgctttccaaccaagtatgtctgctttggtatctttgcctctctttgtctctgcatttcctttcctggatctctgtctttatttccaggcttctccacccatattcctccacagatctctcttccttgacatttgtgcttttctccctgggcctcattttaatgttcagtgagaagtaaacagagcagaagtgaccactgggacttcaggcaagaagctcaccaccaggcacacagcaaagggactgaactgacccctgtttgcactaagccacccccaccccccactctgctttcccaagcttgactggcatatacctaggcctgtgtgtgtgtgtgtgtgtgtgtgtgtgtgtgtgtgtgtgctcttccgtctaaggcatgaataagaggggaggtcaaaataaagacccaatctgaggccgggcacggtggctcacgccggtaatcccagcactttgggaggccgaggcgggcggatcacgaggtcaggagatcgagaccatcctggctaacacggtgaaaccccatttccactaaaaatacaaaaaattagctgggcgtggtggcgagcgcctgtagtcccagctactcgggaggctgaggcaggagaatggcatgaacctggaaggcggagcttgcagtgagctgagattgcgccactgcactccagcctgggcgacggagcgagactctgtctcaaaacaaacaaacaaacaaaagacccaatctgagtcttatcgttgtactgatagaagggtcagatatccccacatggagttgagtgggagaaagagattcactagagaataactccttagagaccaatgtctgtagcaggtgtacagcatcttgtgaaagttatggagcatgaaaagactgaagggccaggacagtttgcatgggctgagttataccagctagaccaggaatagaacaaagaattctatacctcaggatttcaaaaagttagcaacttgagaggccagtgctgagcaacccagtacccaggaaatgaaaaaaagaaagaaaattccctccgagaatgaacaaatcattggcttcattgcctcatgagcttgagagaaaggagaagagagccagagtgtggcaagtgaggccaaaatcagaagcatggcagaaatgagtgtaagtgattgagccacagacagaagtgtggcgagggacaatgccatattgggagaaggtaaagttgagtaacaagaaaccaaccgtgtgtgagagggggattggaaaaaaatttgagggagaagaatgttagaatggaagggaatgatggtggaagggaggtgtgagggtgtgtgctgagtgttgaaagaacggttggtgtctgtgtgattttccttgagtctgttcttcagtgtgtcttctgcagcttgccatgactgcctgggaaagagtagggaaatacccagagccaaaacctcctttcagtcccaccccatccctcaaaaccccagctattgcttcttttcagcttcaggtcctgatctccaatcttagtatggactcccttctcaccaagaccaccaccagctacgtttgctgtgtaatctggaaagtgataatttcctttgcttgttgggtgtgagtcacaatactttggtttgtgcacaagaataaatttatgccccataccttc

SEQ ID NO: 188070 - DNA, 551 bp, Homo sapiens
  Payload ID: 17015
  Gene Symbol: SYNPO2L
  Gene Name: synaptopodin 2-like
  ENST ID: ENST00000606523
  CDS Start-End: 207-551
ctcctagttcaccactgtctgctgccacacgatgttgggaggcctgggaaagctggctgccgagggcctggcccaccgcaccgagaaggccaccgagggagccaattcgaagacggagccaggctggcagagcaggactccgagagagggaccagctcttggcaatcaatggggtctcttgcaccaacctctcccatgccagtgccatgagcctcatcgatgcctcaggaaatcagcttgtcctcactgtgcagcggttagcagacgagggtcctgtgcaatctccatctccccatgagcttcaggtgctgtcacccttatctccactaagtcctgagccccctggtgctccagttcctcagcctcttcagcctgggagccttcgttcacctcctgatagtgaggcttactacggagagactgacagtgatgctgatggccctgccacccaggagaagccccgtcgacctcgccgccgaggccccacaaggcccacccctccgggtgccccacctgatgaggtctacctgtctgacagccctgcagagcca

SEQ ID NO: 188071 - DNA, 2607 bp, Homo sapiens
  Payload ID: 17016
  Gene Symbol: SYNPR
  Gene Name: synaptoporin
  Uniprot ID: Q8TBG9
  ENST ID: ENST00000295894
  CDS Start-End: 370-1167
aaagcagtcctgcacttccagttgtgagccaagagccaagtgtgggagctcaccatggtggcagccacctccccaccaagcaggcagcgttcaccagaggggagtatcaggttcctgtactcagctgtgggttgtcactgtctaataatatgaccgttttgccatctctctgcaaatgaggctgaagctgctatctgattggtataacatctcactttccctctgcattgattttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 188072 - DNA, 1004 bp, Homo sapiens
  Payload ID: 17016
  Gene Symbol: SYNPR
  Gene Name: synaptoporin
  ENST ID: ENST00000450542
  CDS Start-End: 217-321
gactcgcttcgcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggc

SEQ ID NO: 188073 - DNA, 829 bp, Homo sapiens
  Payload ID: 17016
  Gene Symbol: SYNPR
  Gene Name: synaptoporin
  ENST ID: ENST00000465156
  CDS Start-End: 110-715
aaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatc

SEQ ID NO: 188074 - DNA, 2383 bp, Homo sapiens
  Payload ID: 17016
  Gene Symbol: SYNPR
  Gene Name: synaptoporin
  ENST ID: ENST00000460711
  CDS Start-End: 114-944
ataaaaagagggacaagtggctggtgctgtggacagagaagctttatttttagtatgagacaacctctattttctttcaggagagggaagttggattatcaattcttttgtaaatgtgtatggtgatatttgctccgcataatgaagaatgcaagagtcatttccatttactttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcatac

SEQ ID NO: 188075 - DNA, 2436 bp, Homo sapiens
  Payload ID: 17016
  Gene Symbol: SYNPR
  Gene Name: synaptoporin
  ENST ID: ENST00000479198
  CDS Start-End: 119-727
gcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtgctttctgaaattcaatctgcgaaggcacttaagaagagagaaagggttgctactctgactggactgtgatttctgctttggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 188076 - DNA, 2709 bp, Homo sapiens
  Payload ID: 17016
  Gene Symbol: SYNPR
  Gene Name: synaptoporin
  Uniprot ID: Q8TBG9
  ENST ID: ENST00000478300
  CDS Start-End: 412-1269
aagtttccccggagccagagggcaccgggcgcacggctgagcctgcaccaatgtctgtgggccctgcctcgcccacctcctcgccctcccctctggagcgcggctggccaatgacagccttcccctggctccatgggtttccccctcccctgttgtatctaccctgccccagctcttccctgcccacccctcgctgactcgcttcgcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 188077 - DNA, 1304 bp, Homo sapiens
  Payload ID: 17016
  Gene Symbol: SYNPR
  Gene Name: synaptoporin
  ENST ID: ENST00000468110
  CDS Start-End: 207-434
gcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattgctttttgcaatctttgcatttgcaacatgcggtggctattctggaggcctgcggctgagtgtggactgcgtcaacaagacagaaagtaacctcagcatcgacatagcgtttgcctacccattcaggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttattttttttta

SEQ ID NO: 188078 - DNA, 1296 bp, Homo sapiens
  Payload ID: 17016
  Gene Symbol: SYNPR
  Gene Name: synaptoporin
  ENST ID: ENST00000498449
  CDS Start-End: 333-500
aagtgtgggagctcaccatggtggcagccacctccccaccaagcaggcagcgttcaccagaggggagtatcaggttcctgtactcagctgtgggttgtcactgtctaataatatgaccgttttgccatctctctgcaaatgaggctgaagctgctatctgattggtataacatctcactttccctctgcattgattttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcatttt

SEQ ID NO: 188079 - DNA, 527 bp, Homo sapiens
  Payload ID: 17016
  Gene Symbol: SYNPR
  Gene Name: synaptoporin
  ENST ID: ENST00000472899
  CDS Start-End: 137-292
ttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgaaagggtttctcaaacgttttttctctggatctcttcaaaaagctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcatt

SEQ ID NO: 188080 - DNA, 2480 bp, Homo sapiens
  Payload ID: 17017
  Gene Symbol: SNAP23
  Gene Name: synaptosomal-associated protein, 23kDa
  Uniprot ID: O00161
  ENST ID: ENST00000349777
  CDS Start-End: 423-899
ataatttgtttacatatctatatcttagtctagacatattgaaaggcgatgaagagcagggaaagcactgtattcgctttcttttcttcagcgttcatccagcacagtgcctggcatacggtttgccctcagtaaatgtttattgcatgaacacctcccagcttcgggcaggactgaaatctatccggttaactagtgaattcccagactctccgtctgcgtggcagggacatttaaacccccagcaccgtgattggctccagctgcaggggtgtgtctgtgtccgcggcgaacgggaagtgagcaggcgcgcgggctcggcgcgcgcaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaact

SEQ ID NO: 188081 - DNA, 2687 bp, Homo sapiens
  Payload ID: 17017
  Gene Symbol: SNAP23
  Gene Name: synaptosomal-associated protein, 23kDa
  Uniprot ID: O00161
  ENST ID: ENST00000249647
  CDS Start-End: 469-1104
aggcgcctcaaattttctatgtgctatgcactgtattctatccactataatttgtttacatatctatatcttagtctagacatattgaaaggcgatgaagagcagggaaagcactgtattcgctttcttttcttcagcgttcatccagcacagtgcctggcatacggtttgccctcagtaaatgtttattgcatgaacacctcccagcttcgggcaggactgaaatctatccggttaactagtgaattcccagactctccgtctgcgtggcagggacatttaaacccccagcaccgtgattggctccagctgcaggggtgtgtctgtgtccgcggcgaacgggaagtgagcaggcgcgcgggctcggcgcgcgcaggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaactaa

SEQ ID NO: 188082 - DNA, 477 bp, Homo sapiens
  Payload ID: 17017
  Gene Symbol: SNAP23
  Gene Name: synaptosomal-associated protein, 23kDa
  Uniprot ID: O00161
  ENST ID: ENST00000397138
  CDS Start-End: 1-477
atggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaa

SEQ ID NO: 188083 - DNA, 565 bp, Homo sapiens
  Payload ID: 17017
  Gene Symbol: SNAP23
  Gene Name: synaptosomal-associated protein, 23kDa
  ENST ID: ENST00000561526
  CDS Start-End: 191-565
tttttctcaaaaagaatggaggaagaacaaaggcaggcccgcttgcgggagagtcagtacgcagcgttggacgctatgaacagcctccctggcatgcaatggaggaactattttaccctataaactctgggccatcattcagggaaaagcctgtagaagaccacagtcagatattgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggt

SEQ ID NO: 188084 - DNA, 573 bp, Homo sapiens
  Payload ID: 17017
  Gene Symbol: SNAP23
  Gene Name: synaptosomal-associated protein, 23kDa
  ENST ID: ENST00000568451
  CDS Start-End: 131-424
attctattctccttcaaaggcatgcaatggaggaactattttaccctataaactctgggccatcattcagggaaaagcctgtagaagaccacagtcagatattggtgagtgccaagagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagatttaacatcagaagccgggctcagtaactgatcaaagggaactttaagatgcagtcttgtggcgcagtttgggctgctaacctgctatctaaagaacaaagaactttgagtctggcaaggcttataagacaacatggggagatggtggagaaaactcaccttgcaatgtagtatct

SEQ ID NO: 188085 - DNA, 846 bp, Homo sapiens
  Payload ID: 17017
  Gene Symbol: SNAP23
  Gene Name: synaptosomal-associated protein, 23kDa
  ENST ID: ENST00000566035
  CDS Start-End: 51-185
gagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtattggaatatgacagggaagatgaattcactatgagtttgtgacttaattattttgggggctgctatgttaaagtgtgttagtttaagaatactagttctgtctgtagctctaatcctctgagagcttgggtttctaaattattctgtgttgctcttgtaggttttgtttctgttgtttttggtttgttttgttgtactatcagcttttccccccttgtcttagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaagg

SEQ ID NO: 188086 - DNA, 632 bp, Homo sapiens
  Payload ID: 17017
  Gene Symbol: SNAP23
  Gene Name: synaptosomal-associated protein, 23kDa
  ENST ID: ENST00000568841
  CDS Start-End: 1-449
aacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaagcaagcagacagatctgggaatcactgaggatgctctggggaagcatgctgagctcaagacaattctcttccaggcgaagaattttaaggcgtggacagcaagatatcttcactgagatctgagatatctattgaaaaaccacaaaagaataacaggaaaaagcataagcactatactggttacttttagtacattaaaacaaaacaaaaa

SEQ ID NO: 188087 - DNA, 775 bp, Homo sapiens
  Payload ID: 17017
  Gene Symbol: SNAP23
  Gene Name: synaptosomal-associated protein, 23kDa
  ENST ID: ENST00000564153
  CDS Start-End: 95-478
aggcgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaataggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgtt

SEQ ID NO: 188088 - DNA, 834 bp, Homo sapiens
  Payload ID: 17017
  Gene Symbol: SNAP23
  Gene Name: synaptosomal-associated protein, 23kDa
  ENST ID: ENST00000567094
  CDS Start-End: 87-380
ctagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagatttaacatcagaagccgggctcagtaactgatcaaagggaactttaagatgcagtcttgtggcgcagtttgggctgctaacctgctatctaaaggtgatgcttcaaatggcttttctgtgcatgtgcatggattttgtgaatggtgaaaactgtctctaaactgtgtggtggtgtgtagtgtaaagtgaatttgttcttgatgggtgctatctcacaaaagatggacttgacaaaaggaccttaatttataataccatcctttgacaaatgtctctgataactaagtttttgctaaataacatttaagattaccaaaataacaatactcctggagtttcttaagaaatttaaaataggttgatctttgagacagctgctgcagtctagttctgataaaaggtaagggaagtcatgctaaatgcttctctgtcttcatagactttgattttagcatcctgtcttccattaagtttccctact

SEQ ID NO: 188089 - DNA, 557 bp, Homo sapiens
  Payload ID: 17017
  Gene Symbol: SNAP23
  Gene Name: synaptosomal-associated protein, 23kDa
  ENST ID: ENST00000568331
  CDS Start-End: 85-378
agggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagatttaacatcagaagccgggctcagtaactgatcaaagggaactttaagatgcagtcttgtggcgcagtttgggctgctaacctgctatctaaagaacaaagaactttgagtctggcaaggcttataagacaacatggggagatggtggagaaaactcaccttgcaatgtagtatctaaacagccaggcccggtgacaaatggtcag

SEQ ID NO: 188090 - DNA, 570 bp, Homo sapiens
  Payload ID: 17017
  Gene Symbol: SNAP23
  Gene Name: synaptosomal-associated protein, 23kDa
  ENST ID: ENST00000563830
  CDS Start-End: 1-464
aacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggcgaagaattttaaggcgtggacagcaagatatcttcactgagatctgagatatctattgaaaaaccacaaaagaataacaggaaaaagcataagcactatactggttacttttagtacattaaaacaaaacaaaaatctttacttga

SEQ ID NO: 188091 - DNA, 565 bp, Homo sapiens
  Payload ID: 17017
  Gene Symbol: SNAP23
  Gene Name: synaptosomal-associated protein, 23kDa
  ENST ID: ENST00000568859
  CDS Start-End: 238-565
gcttggtgagtctccaggagtgggacggagggagctggccgggatgaagtctgagactatgtcctgagaagaaagagtgtatcgtattggttgaaaagttggtggggtcgggcttaagcggaggagggggctctctggcccttactcggcagatgggcccggagagaggacgggaggtgccgggagaacatcgagggaccagtggaggaagggtagctggatgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaact

SEQ ID NO: 188092 - DNA, 368 bp, Homo sapiens
  Payload ID: 17017
  Gene Symbol: SNAP23
  Gene Name: synaptosomal-associated protein, 23kDa
  ENST ID: ENST00000563873
  CDS Start-End: 1-271
aggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcaagcagacagatctgggaatcactgaggatgctctggggaagcatgctgagctcaagacaattctcttccaggcgaagaattttaaggcgtggacagcaagatatcttcactgagatctgagatatctattgaaaaaccacaaaagaataacaggaaaaagcataagcactatactggttacttttagtacattaaaacaaaacaaaaatc

SEQ ID NO: 188093 - DNA, 855 bp, Homo sapiens
  Payload ID: 17017
  Gene Symbol: SNAP23
  Gene Name: synaptosomal-associated protein, 23kDa
  ENST ID: ENST00000563765
  CDS Start-End: 90-251
gaggaactattttaccctataaactctgggccatcattcagggaaaagcctgtagaagaccacagtcagatattgagttttgattcatcatggataatctgtcatcagaagaaattcaacagagagctcaccagattactgatgagtctctggaaagtacgaggagaatcctgggtttagccattgaggttttgtttctgttgtttttggtttgttttgttgtactatcagcttttccccccttgtcttagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattacctttt

SEQ ID NO: 188094 - DNA, 568 bp, Homo sapiens
  Payload ID: 17017
  Gene Symbol: SNAP23
  Gene Name: synaptosomal-associated protein, 23kDa
  ENST ID: ENST00000566327
  CDS Start-End: 143-568
agggtgcagcgccaggtccggtgttggggtgtccgagttgccgccggagaggagtggcctcgcccgcttgtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaa

SEQ ID NO: 188095 - DNA, 210 bp, Homo sapiens
  Payload ID: 17017
  Gene Symbol: SNAP23
  Gene Name: synaptosomal-associated protein, 23kDa
  ENST ID: ENST00000627440
  CDS Start-End: 76-210
cgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtattggaatatgacagggaagatgaattcactatga

SEQ ID NO: 188096 - DNA, 237 bp, Homo sapiens
  Payload ID: 17017
  Gene Symbol: SNAP23
  Gene Name: synaptosomal-associated protein, 23kDa
  ENST ID: ENST00000626061
  CDS Start-End: 76-237
cgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgaggttttgtttctgttgtttttggtttgttttgttgtactatcagcttttccccccttgtcttag

SEQ ID NO: 188097 - DNA, 2053 bp, Homo sapiens
  Payload ID: 17018
  Gene Symbol: SNAP25
  Gene Name: synaptosomal-associated protein, 25kDa
  Uniprot ID: P60880
  ENST ID: ENST00000254976
  CDS Start-End: 212-832
atctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgaggtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 188098 - DNA, 2050 bp, Homo sapiens
  Payload ID: 17018
  Gene Symbol: SNAP25
  Gene Name: synaptosomal-associated protein, 25kDa
  Uniprot ID: P60880
  ENST ID: ENST00000304886
  CDS Start-End: 209-829
tttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgaggtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 188099 - DNA, 492 bp, Homo sapiens
  Payload ID: 17018
  Gene Symbol: SNAP25
  Gene Name: synaptosomal-associated protein, 25kDa
  ENST ID: ENST00000430336
  CDS Start-End: 212-492
gggtaaatacaagtattggtgcacttagggtgcggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaa

SEQ ID NO: 188100 - DNA, 4287 bp, Homo sapiens
  Payload ID: 17019
  Gene Symbol: SNAP29
  Gene Name: synaptosomal-associated protein, 29kDa
  Uniprot ID: O95721
  ENST ID: ENST00000215730
  CDS Start-End: 129-905
acctgcgcgcgacgcgcggaaggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaaatttc

SEQ ID NO: 188101 - DNA, 681 bp, Homo sapiens
  Payload ID: 17019
  Gene Symbol: SNAP29
  Gene Name: synaptosomal-associated protein, 29kDa
  ENST ID: ENST00000439214
  CDS Start-End: 201-681
gtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaa

SEQ ID NO: 188102 - DNA, 2367 bp, Homo sapiens
  Payload ID: 17020
  Gene Symbol: SNAP47
  Gene Name: synaptosomal-associated protein, 47kDa
  Uniprot ID: Q5SQN1
  ENST ID: ENST00000315781
  CDS Start-End: 415-1809
gcggccgccgccccaccgtaggtccgtagcaggtggtcgaagtcgggcctccccgcgggcgtcacccagcgccgccggctgccccagccctgcgtgaaggcgctggaaaacacgcagggcaggttgggcagcaagaagccccgcacaaagtcggcgtaggagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttcagagtg

SEQ ID NO: 188103 - DNA, 2362 bp, Homo sapiens
  Payload ID: 17020
  Gene Symbol: SNAP47
  Gene Name: synaptosomal-associated protein, 47kDa
  Uniprot ID: Q5SQN1
  ENST ID: ENST00000366759
  CDS Start-End: 415-1809
gcggccgccgccccaccgtaggtccgtagcaggtggtcgaagtcgggcctccccgcgggcgtcacccagcgccgccggctgccccagccctgcgtgaaggcgctggaaaacacgcagggcaggttgggcagcaagaagccccgcacaaagtcggcgtaggagaaggcgcccggctccgagacgaaggctacccggcccggagcctggccgacgccggggacatcgacccccaggcctcggaagtggctgtcggcgagggcgcgcgtctcgcggtccatccagctcagcacgggtcgaaggaccctcctcctcacttccgccggagcggaaacggtgaggaccagcctcggaaccagaagacgcagggcgccgcgtttctgccccgccagcgcctggggctccgggcctgcacgcatgcgcgcggctcgccgcggtcttcactgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttca

SEQ ID NO: 188104 - DNA, 1446 bp, Homo sapiens
  Payload ID: 17020
  Gene Symbol: SNAP47
  Gene Name: synaptosomal-associated protein, 47kDa
  Uniprot ID: Q5SQN1
  ENST ID: ENST00000366760
  CDS Start-End: 225-893
atgagggcaaggctccggttcctgccctcacagggtcccagaagcaagggcagtgaggacctggcccacgtccctggcacgggctgtctgattctccttcgctgtggcgggaagatggccggatttgaagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttca

SEQ ID NO: 188105 - DNA, 1867 bp, Homo sapiens
  Payload ID: 17020
  Gene Symbol: SNAP47
  Gene Name: synaptosomal-associated protein, 47kDa
  ENST ID: ENST00000418653
  CDS Start-End: 1-778
cttcactgcgcaggcgccgagcggccgaggcgccgcggtcggctctgggactcgtctggcgtccctcagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagggcttccggcctatgtcgctgtcaacccagacagtgttggtgatgctttgctccgagtctgcaggagctttgtggagacagagactttcctagcagggcagcaagcggaagcttttcttccagaacagcctttgctcagggcatgagggagccggccaggcccacagcgcccagggcatcctcctcacggatgtgttggaggaaagtggctttggtgctatcctgggggaccatggccataagctggcagtgtcagccacgcatcagttgcgtttctttgttcaggttgtgcctcttgctgcctgcctgagtcacccagggctgctccccttcctggctctgacgccctcagcgggtcccacaagccgctcaggaccacagagtctggccatgggtctggccaggcatccactgatgctctaagctgcagcttctcttaggaacacttctatcaggtctggctcgcaggcatgccccagggccagcctggattgtactgtccttcaagcactccttgctctatttctttgaagtttataaaagtttgtttcccccaaaacccaaagcacttttaatcaggtagtttctgtggaggtcgaactggctggaaggaaggctggttcctggatttctttactcatgtagcagggactcaaggaagtctgatttgcgcctcgcctctgactcagagcccatgaaggttcctgtgtgaggccactggctgcctcggagctgacagcatcctgcacaatggctagatggcttgtcaccccaggccgcagaggaacaactgtttctagggtttggccagacttcacattctccattctttccatccctgttatgtggaatgcacacgatgccatgtaattacttcagtcccttctcaaaggaaaaagaatctggacctgcactccaggacactagcagtttgaaggttcgctcaggaatgttctttgtctgcagacctagcagctgtacagatcgctcttgtgtttttgcactattaattaacttcaagtgcaattttggcaggcaggccaagggtctcaacaggctatttggaatgagttctcttttaaggccttcaacgtagtgagacattttcaaatcaaaaagtacagcaggagccagcctttattttgtctgtgtacacaataaaatattccgcttctataggca

SEQ ID NO: 188106 - DNA, 2403 bp, Homo sapiens
  Payload ID: 17020
  Gene Symbol: SNAP47
  Gene Name: synaptosomal-associated protein, 47kDa
  ENST ID: ENST00000426344
  CDS Start-End: 1-1315
ctgcgcaggcgccgagcggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagggcttccggcctatgtcgctgtcaacccagacagtgttggtgatgctttgctccgagtctgcaggagctttgtggagacagagactttcctagcagggcagcaagcggaagcttttcttccagaacagcctttgctcagggcatgagggagccggccaggcccacagcgcccagggcatcctcctcacggatgtgttggaggaaagtggctttggtgctatcctgggggaccatggccataagctggcagtgtcagccacgcatcagttgcgtttctttgttcaggttgtgcctcttgctgcctgcctgagtcacccagggctgctccccttcctggctctgacgccctcagcgggtcccacaagccgctcaggaccacagagtctggccatgggtctggccaggcatccactgatgctctaagctgcagcttctcttaggaacacttctatcaggtctggctcgcaggcatgccccagggccagcctggattgtactgtccttcaagcactccttgctctatttctttgaagtttataaaagtttgtttcccccaaaacccaaagcacttttaatcaggtagtttctgtggaggtcgaactggctggaaggaaggctggttcctggatttctttactcatgtagcagggactcaaggaagtctgatttgcgcctcgcctctgactcagagcccatgaaggttcctgtgtgaggccactggctgcctcggagctgacagcatcctgcacaatggctagatggcttgtcaccccaggccgcagaggaacaactgtttctagggtttggccagacttcacattctccattctttccatccctgttatgtggaatgcacacgatgccatgtaattacttcagtcccttctcaaaggaaaaagaatctggacctgcactccaggacactagcagtttgaaggttcgctcaggaatgttctttgtctgcagacctagcagctgtacagatcgctcttgtgtttttgcactattaattaacttcaagtgcaattttggcaggcaggccaagggtctcaacaggctatttggaatgagttctcttttaaggccttcaacgtagtgagacattttcaaatcaaaaagtacagcaggagccagcctttattttgtctgtgtacacaataaaatattccgcttctataggc

SEQ ID NO: 188107 - DNA, 829 bp, Homo sapiens
  Payload ID: 17020
  Gene Symbol: SNAP47
  Gene Name: synaptosomal-associated protein, 47kDa
  ENST ID: ENST00000606873
  CDS Start-End: 1-667
ggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcaggttagtgaccgacaaggcagtgagcgcgtgcacagacttctaaaattacaggcagactcagcacgcctgtgggaaatgcctaacagatgcgtcacctagagcagctgctggcctccagcttgctagagacagctcgtttgtttatacataaaaacaattccagacca

SEQ ID NO: 188108 - DNA, 1905 bp, Homo sapiens
  Payload ID: 17020
  Gene Symbol: SNAP47
  Gene Name: synaptosomal-associated protein, 47kDa
  ENST ID: ENST00000617596
  CDS Start-End: 93-1352
ggccgaggcgccgcggtcggctctgggactcgtctggcgtccctcagaggcagaagaggcctggaccttggcgcacacagacccaggaacagatgagcagggatgtctgcatccacacctggccgtgcacctactacctggagcccaagaggcgatgggttactggacagctgtccttaacatcgctgtcgctcaggttcatgactgacagcactggagagattctggtcagcttccccctctccagcatagttgagatcaagaaggaggcttcacattttatcttcagctccatcaccatcctggagaagggccatgccaagcactggttcagctccctgcggccaagtcgaaatgtggtcttcagcatcatcgagcatttctggagggagctgctgctgtctcagcctggagccgtggcagacgcatctgtcccaaggacccggggcgaggagctgacgggactcatggctggatcccagaaacgcctggaggacacggcgagggtcctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccagatcctgaggaggatgaaggggctggccctggaggccgagagtgagctggagagacaagacgaagccctggatggcgttgcagcagctgtggacagggcaaccttgaccatcgacaagcacaacaggcggatgaagaggctgacctaggggcagaacgtccctgcattcctgtctcaccctgcacatcccgctgagatggagggctgggcggcagtgccagggctgcagaggcctgtggccctccggagtggtcttcctctggatggggctgctactgtggggctgcttctgcaccaggggcctccccaggtgtgcaccatgcctgcctcccacttggctgtccctgctgctgggcaggacccggccacatgttctgcggatgctgcagaagtgtggaccatggcgggaccccaaggacacttggcacaggcctggaagaggccgccctcgtcttgtctcggctccctttcatggacagactggccttcttagctgtactataaatttgtgagtgaagttagagcccagctcacttagccagctcactttgagggcatcctataaacacccaactgttcttttatcgtctcggttttagccaaaagtgaaattagcatgactgcatctttcaaacaaaaatattgatttctgcttttagggccccgtttccatccagaaataaagggaaatgctggcttca

SEQ ID NO: 188109 - DNA, 870 bp, Homo sapiens
  Payload ID: 17020
  Gene Symbol: SNAP47
  Gene Name: synaptosomal-associated protein, 47kDa
  ENST ID: ENST00000478768
  CDS Start-End: 1-771
ctgcaccaccagggccagcagctggacagcgtcatgagaggcctggacaagatggagtcagacctggaggtggcggacagattgctgacagaactggaatctcctgcttggtggccctttagctccaagctttggaagacaccaccggaaacaaagcccagggaagatgtctccatgaccagttgtgaaccctttgggaaagaagggatactgataaaaattcctgctgttatttcccacagaacagagtctcacgttaaaccagggaggctcaccgtccttgtgtctgggttggaaatacatgactccagttctttgctcatgcacaggtttgaaagagaagacgtggacgacatcaaggtccactcaccttacgaaattagcatccgccagcggtttattggaaagccagacatggcctatcgtttgatatctgccaagatgccagaggttatccccattttagaagtgcagttcagcaagaagatggagctgttagaagatgcattggtgctcagaagcgcaagaacctcttcccccgcagagaagagctgctcagtctggcatgcagcatctgggctgatgggccgtaccctgcaccgtgagccacccgcaggagaccaggagggcacagcactgcacctgcagacaagcctgccagccctttctgaggcagatacccaggaactaacccaggaactggagaatgcattgcatcttcctcagggacccccgttcctggtctggcttccctcacttccctatccctgatgtctctaatctaaactttcctcaattaatctgtgtcctctcctagtcaggggaaaaaacatgtgtgtgtacctaatgaatgtaagataatcatattca

SEQ ID NO: 188110 - DNA, 4434 bp, Homo sapiens
  Payload ID: 17021
  Gene Symbol: SNAP91
  Gene Name: synaptosomal-associated protein, 91kDa
  ENST ID: ENST00000195649
  CDS Start-End: 315-3023
agctgaggtgggggcggggatggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaa

SEQ ID NO: 188111 - DNA, 546 bp, Homo sapiens
  Payload ID: 17021
  Gene Symbol: SNAP91
  Gene Name: synaptosomal-associated protein, 91kDa
  ENST ID: ENST00000369690
  CDS Start-End: 100-546
atccgatgcattccccgaagcctgcgggctgctaggaggaaagtctgctgaggtgggagatgggcaccgaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaag

SEQ ID NO: 188112 - DNA, 429 bp, Homo sapiens
  Payload ID: 17021
  Gene Symbol: SNAP91
  Gene Name: synaptosomal-associated protein, 91kDa
  ENST ID: ENST00000369691
  CDS Start-End: 1-429
cacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggaggtagtgcagaggctgcacctgagctggacctctttgcaatgaagccacctgagaccagtgttcctgtagttacccctacagctagcacagcccctccagttcccgcaactgctccttctcctgctcc

SEQ ID NO: 188113 - DNA, 4449 bp, Homo sapiens
  Payload ID: 17021
  Gene Symbol: SNAP91
  Gene Name: synaptosomal-associated protein, 91kDa
  Uniprot ID: O60641
  ENST ID: ENST00000369694
  CDS Start-End: 315-3038
agctgaggtgggggcggggatggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaa

SEQ ID NO: 188114 - DNA, 4452 bp, Homo sapiens
  Payload ID: 17021
  Gene Symbol: SNAP91
  Gene Name: synaptosomal-associated protein, 91kDa
  Uniprot ID: O60641
  ENST ID: ENST00000439399
  CDS Start-End: 318-3041
gtggtgcgcgagcccagtgcgtgccgggtgcggcgccagcagcggaggggcggcccggcgcccagcggagagccgctggctgggtgggtgtcggcctccccgcctccttcttctccccgccggcttgccggggatgcttgcgcgaggcgccccctcgcctttaagctcccggccccggggggcggtgtgtgtgagtagctgggagggggccgcgaggcgctccgccgagggctcgtccgggtttgtccgccgccgtcacctgactcgtcggaggagccacagctgagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaa

SEQ ID NO: 188115 - DNA, 735 bp, Homo sapiens
  Payload ID: 17021
  Gene Symbol: SNAP91
  Gene Name: synaptosomal-associated protein, 91kDa
  ENST ID: ENST00000523484
  CDS Start-End: 387-735
gggcgggggactgggcttcgctgtcagcccggctcctctccaaagccaggaagggtgaggcgccccaagactccggcgcctccgcagagctcccgggcggcccctgcggcagggatttggaaccggggggaaggggcccgggcgatgggcctcggcgaggctttggagccggcggcgaggaaggaaggggaggcgagggcataacatggcgcaacgctaggataatctccttcgcgactgagggaggacgagccctttgctgcagcagcgcgaggaggaggagggaggcagccagggcttgggtatccgatgcattccccgaagcctgcgggctgctaggaggaaagtctgctgagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatg

SEQ ID NO: 188116 - DNA, 2168 bp, Homo sapiens
  Payload ID: 17021
  Gene Symbol: SNAP91
  Gene Name: synaptosomal-associated protein, 91kDa
  Uniprot ID: O60641
  ENST ID: ENST00000520213
  CDS Start-End: 99-1901
agtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggaggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgat

SEQ ID NO: 188117 - DNA, 2822 bp, Homo sapiens
  Payload ID: 17021
  Gene Symbol: SNAP91
  Gene Name: synaptosomal-associated protein, 91kDa
  ENST ID: ENST00000521616
  CDS Start-End: 176-307
cgccagggtctcgcggggatccgcagaggataatcccagggtgcggagaagggcagcggccgagtgacagctccgcggagcgctccagggcgggcgggggactgggcttcgctgtcagcccggctcctctccaaagccaggaaggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttc

SEQ ID NO: 188118 - DNA, 4263 bp, Homo sapiens
  Payload ID: 17021
  Gene Symbol: SNAP91
  Gene Name: synaptosomal-associated protein, 91kDa
  Uniprot ID: O60641
  ENST ID: ENST00000521743
  CDS Start-End: 135-2858
gactcgtcggaggagccacagctgaggtgggggcggggatggggacgcagctcggagcgctagagagacgcggcggcgctggcagaagaggcggcggcgggcggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaa

SEQ ID NO: 188119 - DNA, 4136 bp, Homo sapiens
  Payload ID: 17021
  Gene Symbol: SNAP91
  Gene Name: synaptosomal-associated protein, 91kDa
  Uniprot ID: O60641
  ENST ID: ENST00000520302
  CDS Start-End: 98-2731
gtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaa

SEQ ID NO: 188120 - DNA, 482 bp, Homo sapiens
  Payload ID: 17021
  Gene Symbol: SNAP91
  Gene Name: synaptosomal-associated protein, 91kDa
  ENST ID: ENST00000523199
  CDS Start-End: 75-251
gggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactacctacaaaccttctttcaacaagtgcttcctaattttgagatctgaaagtatgttccagcatcttttgagtcatacaaccaaagtatgaggagatcacaagtcttttaaaaagttgtgctaaaggagaaatacttcagaaatatgttacatttgttttggatcacagtattatttatttctcaagaagagatttgttcatcatagtagtattaattatggaatgaagggagcaccatcatactgaatttgaattaatttttactaggctttatagaa

SEQ ID NO: 188121 - DNA, 842 bp, Homo sapiens
  Payload ID: 17021
  Gene Symbol: SNAP91
  Gene Name: synaptosomal-associated protein, 91kDa
  ENST ID: ENST00000519779
  CDS Start-End: 386-842
caggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcggggtgagtacccgcggccgtactcggccccctccccgcgccagggtctcgcggggatccgcagaggataatcccagggtgcggagaagggcagcggccgagtgacagctccgcggagcgctccagggcgggcgggggactgggcttcgctgtcagcccggctcctctccaaagccaggaaggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccg

SEQ ID NO: 188122 - DNA, 542 bp, Homo sapiens
  Payload ID: 17021
  Gene Symbol: SNAP91
  Gene Name: synaptosomal-associated protein, 91kDa
  ENST ID: ENST00000522248
  CDS Start-End: 66-428
tcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatgggccgatggtgtaatgaggacaatggctcccgaaaagctgctaaagagtatgccaatactacagggacaaattgatgcactgcttgaatttgatgtgcatccaaatgaactaacaaatggtgtcataa

SEQ ID NO: 188123 - DNA, 4521 bp, Homo sapiens
  Payload ID: 17021
  Gene Symbol: SNAP91
  Gene Name: synaptosomal-associated protein, 91kDa
  ENST ID: ENST00000521485
  CDS Start-End: 397-3105
gagacaagcggaggagcctgaggagctgaagacgcacaggtgacggtcgcggatggccggcaggatctgacatttaaaatcgccctgctcatctgggcctcggagcctttgacaggcgggcgtgtcagcgacagtgtggggaaggggctgggctccgccaggcagcgcgcgacgacgcccttgccttggccttcacagagtagaacccgagaagcccactcgcccgtcttggccaacgcccccaacgcccagggctccccccgcagtcggcgggcaggtgtgcgtggtgcgcgagcccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaacataa

SEQ ID NO: 188124 - DNA, 4493 bp, Homo sapiens
  Payload ID: 17021
  Gene Symbol: SNAP91
  Gene Name: synaptosomal-associated protein, 91kDa
  ENST ID: ENST00000518312
  CDS Start-End: 101-277
ccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactacctacaaaccttctttcaacaagtgcttcctaattttgagatctgaaagtatgttccagcatcttttgagtcatacaaccaaagtatgaggagatcacaagtcttttaaaaagttgtgctaaaggagaaatacttcagaaatatgttacatttgttttggatcacagtattatttatttctcaagaagagatttgttcatcatagtagtattagcccggtgcaggaagaactcaagtaaaagacaagaaaaaacaaaaaacagtgttgattgtgggatattaaggaaggctagaatttaagcaactgagtaaagtaaaatgatgtactgagaactaaagttgtattccttggtacttccgagagaaaacagacttggatttttattggatgattcctcctaggaagtaagatgagggcgttcaagaataataacaatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatgctttctcctctccaccacaaggggcctctcctgtgcctgagagttctctcactgctgacctcttatctgatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaa

SEQ ID NO: 188125 - DNA, 564 bp, Homo sapiens
  Payload ID: 17021
  Gene Symbol: SNAP91
  Gene Name: synaptosomal-associated protein, 91kDa
  ENST ID: ENST00000523585
  CDS Start-End: 87-263
gtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactacctacaaaccttctttcaacaagtgcttcctaattttgagatctgaaagtatgttccagcatcttttgagtcatacaaccaaagtatgaggagatcacaagtcttttaaaaagttgtgctaaaggagaaatacttcagaaatatgttacatttgttttggatcacagtattatttatttctcaagaagagatttgttcatcatagtagtattagcccggtgcaggaagaactcaagtaaaagacaagaaaaaacaaaaaacagtgttgattgtgggatattaaggaaggctagaatttaagcaactgaggtaaaagcagagtatgttccaggttcacaacaaacatt

SEQ ID NO: 188126 - DNA, 1745 bp, Homo sapiens
  Payload ID: 17021
  Gene Symbol: SNAP91
  Gene Name: synaptosomal-associated protein, 91kDa
  ENST ID: ENST00000521931
  CDS Start-End: 1-1745
atgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttgg

SEQ ID NO: 188127 - DNA, 889 bp, Homo sapiens
  Payload ID: 17021
  Gene Symbol: SNAP91
  Gene Name: synaptosomal-associated protein, 91kDa
  ENST ID: ENST00000523448
  CDS Start-End: 1-669
gtgcctgagagttctctcactgctgacctcttatctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaa

SEQ ID NO: 188128 - DNA, 591 bp, Homo sapiens
  Payload ID: 17021
  Gene Symbol: SNAP91
  Gene Name: synaptosomal-associated protein, 91kDa
  ENST ID: ENST00000518309
  CDS Start-End: 140-591
atgctgcgactggagcccacgctggggttccgtgacggccctactcacggccaagactccctggaccgcatcgcaggagcggggcttggcgcgttgctggctccgagagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaagg

SEQ ID NO: 188129 - DNA, 525 bp, Homo sapiens
  Payload ID: 17021
  Gene Symbol: SNAP91
  Gene Name: synaptosomal-associated protein, 91kDa
  ENST ID: ENST00000519825
  CDS Start-End: 328-525
ggggactgggcttcgctgtcagcccggctcctctccaaagccaggaagggtgaggcgccccaagactccggcgcctccgcagagctcccgggcggcccctgcggcagggatttggaaccggggggaaggggcccgggcgatgggcctcggcgaggctttggagccggcggcgaggaaggaaggggaggcgagggcataacatggcgcaacgctaggataatctccttcgcgactgagggaggacgagccctttgctgcagcagcgcgaggaggaggagggaggcagccagggcttggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgg

SEQ ID NO: 188130 - DNA, 6449 bp, Homo sapiens
  Payload ID: 17022
  Gene Symbol: SYNCRIP
  Gene Name: synaptotagmin binding, cytoplasmic RNA interacting protein
  Uniprot ID: O60506
  ENST ID: ENST00000355238
  CDS Start-End: 208-1896
cgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtct

SEQ ID NO: 188131 - DNA, 3023 bp, Homo sapiens
  Payload ID: 17022
  Gene Symbol: SYNCRIP
  Gene Name: synaptotagmin binding, cytoplasmic RNA interacting protein
  Uniprot ID: O60506
  ENST ID: ENST00000369622
  CDS Start-End: 502-2373
ctgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaatgtatacttactaaaattgtgtttacaattcgtttttcacaaaatttcctgcaaatttggttcaaattgtatagcatgtcaaggccaattaaagggttttgtgccttgttaa

SEQ ID NO: 188132 - DNA, 610 bp, Homo sapiens
  Payload ID: 17022
  Gene Symbol: SYNCRIP
  Gene Name: synaptotagmin binding, cytoplasmic RNA interacting protein
  ENST ID: ENST00000444272
  CDS Start-End: 56-610
gcggccgcggagccgggggcgggggccgggcgcgcacagaccgatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagct

SEQ ID NO: 188133 - DNA, 6764 bp, Homo sapiens
  Payload ID: 17022
  Gene Symbol: SYNCRIP
  Gene Name: synaptotagmin binding, cytoplasmic RNA interacting protein
  ENST ID: ENST00000616122
  CDS Start-End: 273-1667
cggcgtgagcttcggccgccattttacaacagctccactcgcgccggacacagggagcagcgagcacgcgtttcccgcaacccgataccatcggacaggatttctccgcctcagcccaacggggagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaatt

SEQ ID NO: 188134 - DNA, 4808 bp, Homo sapiens
  Payload ID: 17023
  Gene Symbol: SYT1
  Gene Name: synaptotagmin I
  Uniprot ID: P21579
  ENST ID: ENST00000261205
  CDS Start-End: 658-1926
caatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgtt

SEQ ID NO: 188135 - DNA, 3095 bp, Homo sapiens
  Payload ID: 17023
  Gene Symbol: SYT1
  Gene Name: synaptotagmin I
  Uniprot ID: P21579
  ENST ID: ENST00000393240
  CDS Start-End: 672-1940
atctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctgggcatgctcagtatcagggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaag

SEQ ID NO: 188136 - DNA, 4592 bp, Homo sapiens
  Payload ID: 17023
  Gene Symbol: SYT1
  Gene Name: synaptotagmin I
  ENST ID: ENST00000457153
  CDS Start-End: 449-1708
agcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccagggaaaacgggaaaactagcaagagctagcaagaactagcaagagcttgaacaaacgcctggactcagattggaagactgctcatttgtctactgcctcattcctggaaattgcactggaactgtctgattaagcttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttga

SEQ ID NO: 188137 - DNA, 762 bp, Homo sapiens
  Payload ID: 17023
  Gene Symbol: SYT1
  Gene Name: synaptotagmin I
  ENST ID: ENST00000446242
  CDS Start-End: 218-762
agatgccatgagaactcttaaaaacagagtaacatacttattataagacctattttaaatatttcattctttcctcattttcatgatacctaaattttttgaagactgaaaatgatgagaacttatataaaaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgt

SEQ ID NO: 188138 - DNA, 702 bp, Homo sapiens
  Payload ID: 17023
  Gene Symbol: SYT1
  Gene Name: synaptotagmin I
  ENST ID: ENST00000552074
  CDS Start-End: 419-702
tttaaagaaagatgacggtgtcttaggaatgcttttaagggttctttggttgaaagtctgggaatactcagagataatattaatgagagcctagagtttttttcttttaaaatggggttccatggctttgggcagaaatgatttttatatgtatcatgattgaaaaaactctcagtacaagatgatgcacttctttatacagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaagga

SEQ ID NO: 188139 - DNA, 2718 bp, Homo sapiens
  Payload ID: 17023
  Gene Symbol: SYT1
  Gene Name: synaptotagmin I
  Uniprot ID: P21579
  ENST ID: ENST00000552744
  CDS Start-End: 280-1548
atcttggctcctccctgattctaccaccaagaataaaatagttgtttgtcccctacagtagaacaagtttgcccattcatccttgtgatagatatgcatgcaaaaccaaaatgaaatcaaatccccacagatggctcgtaagtcaaaaacactgtttaattctttcactgcatccctttgggaagcctggcccttgaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggccctcaaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagagcaagagaaattgggtgatatctgcttctcccttcgctacgtacctactgctggtaagctgactgttgtcattctggaggcaaagaacctgaagaagatggatgtgggtggcttatccgatccttatgtgaagattcatctgatgcagaatggtaagaggctgaagaagaaaaagacaacaattaaaaagaacacacttaacccctactacaatgagtcattcagctttgaagtaccttttgaacaaatccagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaa

SEQ ID NO: 188140 - DNA, 579 bp, Homo sapiens
  Payload ID: 17023
  Gene Symbol: SYT1
  Gene Name: synaptotagmin I
  ENST ID: ENST00000551304
  CDS Start-End: 362-579
ctctctctctcaagggaaaacgggaaaactagcaagagctagcaagaactagcaagagcttgaacaaacgcctggactcagattggaagactgctcatttgtctactgcctcattcctggaaattgcactggaactgtctgattaagcctcctttcactccgtgcccaattcctgcagttgttgctgaggtttaccagatggattaaaagaaaaaataagaagtggctccaaacataaaaacagaataattctgaaagaaagaaaacaaagaaaaacatactccagaattcctaatagaacaatacagaaactgaggtacacagagccatttaccccaggtcaacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcct

SEQ ID NO: 188141 - DNA, 726 bp, Homo sapiens
  Payload ID: 17023
  Gene Symbol: SYT1
  Gene Name: synaptotagmin I
  ENST ID: ENST00000552624
  CDS Start-End: 206-726
attcatccttgtgatagatatgcatgcaaaaccaaaatgaaatcaaatccccacagatggctcgtaagtcaaaaacactgtttaattctttcactgcatccctttgggaagcctggcccttgaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggatgatgatgctgaaactggattgacagatggagaagaaaaagaagaacccaaagaagaggagaaactgggaaaacttcagtattcactggattatgatttccaaaataaccagctgctggtagggatcattcaggctgccgaactgcccgccttggacatggggggcac

SEQ ID NO: 188142 - DNA, 506 bp, Homo sapiens
  Payload ID: 17023
  Gene Symbol: SYT1
  Gene Name: synaptotagmin I
  ENST ID: ENST00000547046
  CDS Start-End: 333-506
attttggaggaatctttggcattctgaatcatcctcctataacactttcccatccaggccccacccaactaatttttaatcataatttagatctcaacacaaaggctggcacaaagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccg

SEQ ID NO: 188143 - DNA, 710 bp, Homo sapiens
  Payload ID: 17023
  Gene Symbol: SYT1
  Gene Name: synaptotagmin I
  ENST ID: ENST00000549671
  CDS Start-End: 494-710
aacagaagatgtcagaatgatatgaaaaagttgctcttttgaaatgtttgttcttctagatttttttaaaatgtcagcatgattcatacctattggttcttagcctggagcacccagcacaaccaggaattgaggaagctagagcaggatgtgaataacgaatgggctgcataagcagaagtctatacccagtcaataagcagaagtctatacccagtcagtgtgcagagttgcaggctagcattttcacagattctattattctctctctctcaagggaaaacgggaaaactagcaagagctagcaagaactagcaagagcttgaacaaacgcctggactcagattggaagactgctcatttgtctactgcctcattcctggaaattgcactggaactgtctgattaagaaaaacagaataattctgaaagaaagaaaacaaagaaaaacatactccagaattcctaatagaacacttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccattgccaccgtgggccttaattgcaatagccatagtcgcagtccttttagtcc

SEQ ID NO: 188144 - DNA, 7614 bp, Homo sapiens
  Payload ID: 17024
  Gene Symbol: SYT2
  Gene Name: synaptotagmin II
  Uniprot ID: Q8N9I0
  ENST ID: ENST00000367267
  CDS Start-End: 194-1453
atagagagagggagagactcgagagcgagcgagcgcgggagcgagggccgcagcggcagggccggcggggaagtgggaagagggacctggacttcgggaccccagctgtccccgcccccgcccccgcccccgccctctccaccagctcaggctgaacgcgcccggaacgtcccaggctgtttcctctgccaccatgaggaacattttcaagaggaaccaggagcctattgtggctcctgccaccaccaccgccacgatgcccattggacccgtggacaactccactgagagtgggggtgctggggagagccaggaggacatgtttgccaaactgaaggagaagttattcaatgagataaacaagattcccttaccaccctgggcactgatcgccattgctgtggttgctgggctcctgcttctcacctgctgcttctgcatctgcaagaaatgctgctgcaagaagaagaagaacaagaaggagaagggcaaaggcatgaagaatgccatgaacatgaaggacatgaaagggggtcaggatgacgacgacgcagagacaggcctgactgagggggaaggtgaaggggaggaggagaaagagccagagaacctgggcaaactgcagttttccctggactatgattttcaggctaatcagcttactgtgggcgttctgcaggctgctgaactgcctgccctggacatgggaggcacctcagacccttatgtcaaggtcttcctccttcctgacaagaagaagaaatatgagaccaaagtccatcggaagacactgaaccctgccttcaatgaaaccttcaccttcaaggtgccataccaggagcttgggggcaaaactctggtgatggccatctatgactttgaccgcttctccaaacatgacatcattggagaggtaaaggtgcctatgaacacagtggacctcggccagcccattgaggagtggagagacctgcaaggcggggaaaaggaggagccggagaagctgggcgacatctgcacctccctgcgctatgtgcccacggccgggaagctcactgtctgcatcctggaggctaagaacctcaagaagatggacgtgggcggcctttcagacccgtacgtgaagatccacctgatgcagaatggcaagaggctcaagaagaagaagacaaccgtgaagaagaagaccctgaacccatacttcaacgagtccttcagctttgagatccccttcgagcagattcagaaagtccaggtagtggtcaccgtgctggactatgacaagctgggcaagaacgaagccataggcaagatcttcgtgggcagcaatgccacgggcacagagctgcggcactggtccgacatgctggccaacccccggaggcccatcgcccagtggcactcgctcaagcctgaggaggaggtggatgcactcctgggcaagaacaagtagacagcagcggctgggaccccacacctttcacggacactgacaagatccagagctatcaatacctcagttatgcaaccttagaggttttcttttttctttcatttgttgggtggttgtgtccttgtttttccttgtttttctctttttaaagaccaacttccctttgatggctgtgtgaggagagtcccctaagaggtgaaagagaagcctggctctgttcacggtcccaggagctgtccttgctgcatgccctgtcacagttccctcgactctttcaaagcttcacatctgcctcaccccaagcgaggctctctactggcacaaacttgcagcagttcctgttttttgagccttctggaccaacaaaatggcagcacatcctgcttcctgacagggaaggcatcacagtggccaatgatcgtgtgtgtgtgtgtgtgtgtgtgtgtgtatgtgtgtgtgtgtgtgtgtgtgtgtgtgtgtgtgtgtgtctttgagcatttctcttcattcctggaatgtgtgtgtgtgtgtgtctctttgagcatctctcttcattcctggaatgagccatggacagtaaagttgtgtgggaaaagaaggctctttggggaccctgacatgaagaagtccactaagtgggagatcttctctcatctatggcaaagtctcaggatcctgttcagatatcggggctttcatactcctgttggtggctatttgggaggcagcaagatgtgaagactggatgtgttcagaactaggaccaaacgatgccatcaaatacttcctcctgccagtcatggtttccccagaagtgtagttcctgggacattcatggatatgagctattcactagttgggtcagactaacagggactctcagtcccaaaatctcactcttattgacaataaatatcaaactatgaagaaacagaagtcccattaccagaaagaccaaaattaaactcctggatcttcaccccatccagtgggaaacacagatgctttctccctttccagaatataagcagccaagttcatttgcatttattccccattgtgcttttgcttctgtttctcttttaagtggagcaacactgtctgaagacacgttatctgtgcagagccagagaactttaaaaggaaagtttaaatgttcttagttctcctgaggtccaggtaagaagggggtggtaagaagaggatgggggacagatggctgagatcccttgggaggagatataggggagcactggaattcccccgactcccactccttgctcccttggccctctgccctccatgctggagagctgataggtagctggagtggcccagggagacctatgggaaggacccgtcctaccattagggggcttctctctatgaatgctaagaaacaaagggcatccattccaaatgagtagcagaggtgaccttctagggtttctacccatgctcagttgtatcccattccctgttcaccttttgtccccagcactgatataaaagccatatatatgttagtcaggtttgcactgagtcttcttccaatccttcagcctggacaacagagtgaggtccccttgtggccagaggccagccctccttgcctgccttcctttgacctctcttttccatccatgaagccctcaggcccttgccattttttcaccacagaaaactcatggcttctccagaagcctgagtatctctctttcccagcacaaatggcagcatctctatcctgccccatctgggccacttcagcttcctgtagacacccaagacagatggacagtgttggagggaatcaggctttgaggatccagtgtgaagaagttgcagagtgtctttttattttattttaaaaagggggaaggggcttttggttttgctttgttttttggatgaaggagtgagggaaatgagggaatacccccaccagaaacagactggaaagcctgcctgtctcttggagatccttctttgtcttgttagtggtacatgggaagttatgtttttactggtgtgtgtgtgtgtgtgtgtgtgtgtacttaatgatgggaaggtaagactctgatcaggattatgaactgcggtccttgggaccaaaggtgtggtcatggtagagagttgtaggacaatagggtgttttcagaatctgggtggccacagagtgggatttcctggtatggacatcagaagtcactggactcttctcccaaccccagagttatgggattttggtgctttctcagggtctctccccagactcactcttctcacccatatcccacagactcactcatggagacccccttgtcaatatcccctctacctttactcctttgccctttcccaattcatcttctaccacctggattcttttccattcatgaacttcattcagcccttccaaagcccaagatttgcattcccttgacagggaggaaaggcaatggtaggaacctctggtggtctgggtgtctatgtgcctggtgaccagggctggatttttattactctgagcccactgctagtgaggagccttgaggggtggggacaggttgctgagtgattttgaacgttgacaccagtgtggagccagtgtgggtgtggggagcagtgccttcctcaggtcccagctggtcctgatatgccacgtagtggatggcatctgtcttggtccatgggcttggtgggaacatgcttctgcttgtgtgttttccatacctgagggctgacgtagcttaaaccacagggcatcatgccaaacactcactgctgggcaggtttatttctggggatgtcagggtactggggtgtaggcactaagcaggatagagttagggtgtctggctagtaaggggttctggacgcctctggggctgtgagttttcatctcaaagtctgttccagagaaaggaaagtagtatagaggtgatttttagagaagctgagaccatgaaaacaagcctaatcccatccagaaactggggtaaagtctgaaagttcgttttcttcttcctccctgaataattgttccagaagggatgctaactctgccagagctacaggcagatttttgggctttggaagtggaagctgaggcctggggaaggctgggtaaggaatgctggggcaatctcagacagtaggcaggtgcttggcatgaatgagaagtgactttcctggagtccctcagtagaggatgagatagcagggattaggccacagtctcagatcctgatcttttttcttcctaggaaagcatacataacttgtgtctgcagaatcagtgtgggatgattttgctggcccaaggcttcagcgagagggagaagagaggtcactacagccctcctgtgggtaaaagcagctctcttataaacctgcctccatgcagtggggtgggggtaagggtgggtgacagcaaagaggttgaggaacctccctgggtttggggagtgagagcttccatgttcccttaatgtcctaggttaattcataaggcatctgagtcctgggtctcacccagcctcacagagagaaaaactgtccctgagggtgtcccctcccactcaaaggtagaaagagattgagccaggaactgccctcatatcctctgctctgccccttcccttccctttcctctgcccctcccacctaaagctgtttggggccctttctcagagccctgggtggtggcaggcagggaggagtcccaagatcctggtggccctgagccccatgctatggttgccagatttggcaaataaaaatacaggatgtccagttacatttgaatttcagttcaacaacaaacaattattaagtgtaaatatgtcctaggcaaatagttgggacatatactaaaaaataatttgttgtttatctgaaattcaaatgtaactggtcatcctgcattgtgtctgggaaccctaccctatgacttttccccctctccctttggtcccaaggggccaggaaccccaaggatttgacttaaccagttttttgaactgcaatattgagaaggggacactgtgacttgaagacacatgaattactttattttttaagcaacaacaaaataagaaccttctgaagccatttgagcctcatctgcccccatccgtgtatatttaattatatataaaagaagataattacctagaaacatatgaacagaatcttgtttaatcaagatgcatgtctataactttctgtaaatagccgcatggcaatgctgagagtccccttgatccccaacctcaaacccattttacagaactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagccataaagggggcctcctgctggagatttggcctcccttggctcctcccaggagcccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcaggcagagcaggtgtggactaagtcccctgaccttcacacctgctccccagagaagccccagccagttgcaccaagtagcagaggtgagtagaggggcctgggggcttccaaggccccaggtcatcctgttgaactgagagggacaggtagcccccctgcctgcggcccctggccccatgggcacctgagggcagtactgcatgggaagagcccaggatgcctcaggcctggcaactgtgacaagtatgaggaaggagagagaacgggaagggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaa

SEQ ID NO: 188145 - DNA, 7598 bp, Homo sapiens
  Payload ID: 17024
  Gene Symbol: SYT2
  Gene Name: synaptotagmin II
  Uniprot ID: Q8N9I0
  ENST ID: ENST00000367268
  CDS Start-End: 178-1437
acttcggagccgagttggggcagcggtggagcggggacttcgcgcccccaggggaacgggcgcccctgcgaaaccgtcgccagccacgcgtccttgccgtccgacgccccctcacattggagaccccggatctctcccgcctccttcgggtcgctctccgctgtttcctctgccaccatgaggaacattttcaagaggaaccaggagcctattgtggctcctgccaccaccaccgccacgatgcccattggacccgtggacaactccactgagagtgggggtgctggggagagccaggaggacatgtttgccaaactgaaggagaagttattcaatgagataaacaagattcccttaccaccctgggcactgatcgccattgctgtggttgctgggctcctgcttctcacctgctgcttctgcatctgcaagaaatgctgctgcaagaagaagaagaacaagaaggagaagggcaaaggcatgaagaatgccatgaacatgaaggacatgaaagggggtcaggatgacgacgacgcagagacaggcctgactgagggggaaggtgaaggggaggaggagaaagagccagagaacctgggcaaactgcagttttccctggactatgattttcaggctaatcagcttactgtgggcgttctgcaggctgctgaactgcctgccctggacatgggaggcacctcagacccttatgtcaaggtcttcctccttcctgacaagaagaagaaatatgagaccaaagtccatcggaagacactgaaccctgccttcaatgaaaccttcaccttcaaggtgccataccaggagcttgggggcaaaactctggtgatggccatctatgactttgaccgcttctccaaacatgacatcattggagaggtaaaggtgcctatgaacacagtggacctcggccagcccattgaggagtggagagacctgcaaggcggggaaaaggaggagccggagaagctgggcgacatctgcacctccctgcgctatgtgcccacggccgggaagctcactgtctgcatcctggaggctaagaacctcaagaagatggacgtgggcggcctttcagacccgtacgtgaagatccacctgatgcagaatggcaagaggctcaagaagaagaagacaaccgtgaagaagaagaccctgaacccatacttcaacgagtccttcagctttgagatccccttcgagcagattcagaaagtccaggtagtggtcaccgtgctggactatgacaagctgggcaagaacgaagccataggcaagatcttcgtgggcagcaatgccacgggcacagagctgcggcactggtccgacatgctggccaacccccggaggcccatcgcccagtggcactcgctcaagcctgaggaggaggtggatgcactcctgggcaagaacaagtagacagcagcggctgggaccccacacctttcacggacactgacaagatccagagctatcaatacctcagttatgcaaccttagaggttttcttttttctttcatttgttgggtggttgtgtccttgtttttccttgtttttctctttttaaagaccaacttccctttgatggctgtgtgaggagagtcccctaagaggtgaaagagaagcctggctctgttcacggtcccaggagctgtccttgctgcatgccctgtcacagttccctcgactctttcaaagcttcacatctgcctcaccccaagcgaggctctctactggcacaaacttgcagcagttcctgttttttgagccttctggaccaacaaaatggcagcacatcctgcttcctgacagggaaggcatcacagtggccaatgatcgtgtgtgtgtgtgtgtgtgtgtgtgtgtatgtgtgtgtgtgtgtgtgtgtgtgtgtgtgtgtgtgtgtctttgagcatttctcttcattcctggaatgtgtgtgtgtgtgtgtctctttgagcatctctcttcattcctggaatgagccatggacagtaaagttgtgtgggaaaagaaggctctttggggaccctgacatgaagaagtccactaagtgggagatcttctctcatctatggcaaagtctcaggatcctgttcagatatcggggctttcatactcctgttggtggctatttgggaggcagcaagatgtgaagactggatgtgttcagaactaggaccaaacgatgccatcaaatacttcctcctgccagtcatggtttccccagaagtgtagttcctgggacattcatggatatgagctattcactagttgggtcagactaacagggactctcagtcccaaaatctcactcttattgacaataaatatcaaactatgaagaaacagaagtcccattaccagaaagaccaaaattaaactcctggatcttcaccccatccagtgggaaacacagatgctttctccctttccagaatataagcagccaagttcatttgcatttattccccattgtgcttttgcttctgtttctcttttaagtggagcaacactgtctgaagacacgttatctgtgcagagccagagaactttaaaaggaaagtttaaatgttcttagttctcctgaggtccaggtaagaagggggtggtaagaagaggatgggggacagatggctgagatcccttgggaggagatataggggagcactggaattcccccgactcccactccttgctcccttggccctctgccctccatgctggagagctgataggtagctggagtggcccagggagacctatgggaaggacccgtcctaccattagggggcttctctctatgaatgctaagaaacaaagggcatccattccaaatgagtagcagaggtgaccttctagggtttctacccatgctcagttgtatcccattccctgttcaccttttgtccccagcactgatataaaagccatatatatgttagtcaggtttgcactgagtcttcttccaatccttcagcctggacaacagagtgaggtccccttgtggccagaggccagccctccttgcctgccttcctttgacctctcttttccatccatgaagccctcaggcccttgccattttttcaccacagaaaactcatggcttctccagaagcctgagtatctctctttcccagcacaaatggcagcatctctatcctgccccatctgggccacttcagcttcctgtagacacccaagacagatggacagtgttggagggaatcaggctttgaggatccagtgtgaagaagttgcagagtgtctttttattttattttaaaaagggggaaggggcttttggttttgctttgttttttggatgaaggagtgagggaaatgagggaatacccccaccagaaacagactggaaagcctgcctgtctcttggagatccttctttgtcttgttagtggtacatgggaagttatgtttttactggtgtgtgtgtgtgtgtgtgtgtgtgtacttaatgatgggaaggtaagactctgatcaggattatgaactgcggtccttgggaccaaaggtgtggtcatggtagagagttgtaggacaatagggtgttttcagaatctgggtggccacagagtgggatttcctggtatggacatcagaagtcactggactcttctcccaaccccagagttatgggattttggtgctttctcagggtctctccccagactcactcttctcacccatatcccacagactcactcatggagacccccttgtcaatatcccctctacctttactcctttgccctttcccaattcatcttctaccacctggattcttttccattcatgaacttcattcagcccttccaaagcccaagatttgcattcccttgacagggaggaaaggcaatggtaggaacctctggtggtctgggtgtctatgtgcctggtgaccagggctggatttttattactctgagcccactgctagtgaggagccttgaggggtggggacaggttgctgagtgattttgaacgttgacaccagtgtggagccagtgtgggtgtggggagcagtgccttcctcaggtcccagctggtcctgatatgccacgtagtggatggcatctgtcttggtccatgggcttggtgggaacatgcttctgcttgtgtgttttccatacctgagggctgacgtagcttaaaccacagggcatcatgccaaacactcactgctgggcaggtttatttctggggatgtcagggtactggggtgtaggcactaagcaggatagagttagggtgtctggctagtaaggggttctggacgcctctggggctgtgagttttcatctcaaagtctgttccagagaaaggaaagtagtatagaggtgatttttagagaagctgagaccatgaaaacaagcctaatcccatccagaaactggggtaaagtctgaaagttcgttttcttcttcctccctgaataattgttccagaagggatgctaactctgccagagctacaggcagatttttgggctttggaagtggaagctgaggcctggggaaggctgggtaaggaatgctggggcaatctcagacagtaggcaggtgcttggcatgaatgagaagtgactttcctggagtccctcagtagaggatgagatagcagggattaggccacagtctcagatcctgatcttttttcttcctaggaaagcatacataacttgtgtctgcagaatcagtgtgggatgattttgctggcccaaggcttcagcgagagggagaagagaggtcactacagccctcctgtgggtaaaagcagctctcttataaacctgcctccatgcagtggggtgggggtaagggtgggtgacagcaaagaggttgaggaacctccctgggtttggggagtgagagcttccatgttcccttaatgtcctaggttaattcataaggcatctgagtcctgggtctcacccagcctcacagagagaaaaactgtccctgagggtgtcccctcccactcaaaggtagaaagagattgagccaggaactgccctcatatcctctgctctgccccttcccttccctttcctctgcccctcccacctaaagctgtttggggccctttctcagagccctgggtggtggcaggcagggaggagtcccaagatcctggtggccctgagccccatgctatggttgccagatttggcaaataaaaatacaggatgtccagttacatttgaatttcagttcaacaacaaacaattattaagtgtaaatatgtcctaggcaaatagttgggacatatactaaaaaataatttgttgtttatctgaaattcaaatgtaactggtcatcctgcattgtgtctgggaaccctaccctatgacttttccccctctccctttggtcccaaggggccaggaaccccaaggatttgacttaaccagttttttgaactgcaatattgagaaggggacactgtgacttgaagacacatgaattactttattttttaagcaacaacaaaataagaaccttctgaagccatttgagcctcatctgcccccatccgtgtatatttaattatatataaaagaagataattacctagaaacatatgaacagaatcttgtttaatcaagatgcatgtctataactttctgtaaatagccgcatggcaatgctgagagtccccttgatccccaacctcaaacccattttacagaactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagccataaagggggcctcctgctggagatttggcctcccttggctcctcccaggagcccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcaggcagagcaggtgtggactaagtcccctgaccttcacacctgctccccagagaagccccagccagttgcaccaagtagcagaggtgagtagaggggcctgggggcttccaaggccccaggtcatcctgttgaactgagagggacaggtagcccccctgcctgcggcccctggccccatgggcacctgagggcagtactgcatgggaagagcccaggatgcctcaggcctggcaactgtgacaagtatgaggaaggagagagaacgggaagggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaa

SEQ ID NO: 188146 - DNA, 2915 bp, Homo sapiens
  Payload ID: 17025
  Gene Symbol: SYT3
  Gene Name: synaptotagmin III
  Uniprot ID: Q9BQG1
  ENST ID: ENST00000338916
  CDS Start-End: 635-2407
actctatgtctcctctcgttggattgtgacaccgggaggtcagggaactccaggaccttgttctctgctggattcgcagcaaccagcacagcacgtagggcgtagttggtgctggatggatgtttgttgaatgaatgaatgatgaatggctggcaccttgtctgctcatccctaactcctgttccttcatctgtgcagccctaatctttgtttcctcatctgtccatccctttatttgtgcatcctcattcttagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 188147 - DNA, 2838 bp, Homo sapiens
  Payload ID: 17025
  Gene Symbol: SYT3
  Gene Name: synaptotagmin III
  Uniprot ID: Q9BQG1
  ENST ID: ENST00000544769
  CDS Start-End: 560-2332
gaggcggcggcggcggcggctcctcgcccagccccgccccggcccctagatcagacattctctctcattacccggcgcgtgggaacgggtccacagccccttgtccgccctagaacccccatgggctgccgcccgccgccgcctcggctgccacccaggacacggcagagataagcgcagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactcc

SEQ ID NO: 188148 - DNA, 2836 bp, Homo sapiens
  Payload ID: 17025
  Gene Symbol: SYT3
  Gene Name: synaptotagmin III
  Uniprot ID: Q9BQG1
  ENST ID: ENST00000593901
  CDS Start-End: 556-2328
ggcggcggcggcggcagcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 188149 - DNA, 2463 bp, Homo sapiens
  Payload ID: 17025
  Gene Symbol: SYT3
  Gene Name: synaptotagmin III
  Uniprot ID: Q9BQG1
  ENST ID: ENST00000600079
  CDS Start-End: 183-1955
ggcggcagcggcggcagcggcggctccggcccctagatcagacattctctctcattacccggcgcgtgggaacgggtccacagccccttgtccgccctagaacccccatgggctgccgcccgccgccgcctcggctgccacccaggacacggcagagataagcgcaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcggccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtagactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacacccctgcgtctggccggtccccccactgctgctgctatcaacgccagaataaacacactctgtgggtctcactccaa

SEQ ID NO: 188150 - DNA, 586 bp, Homo sapiens
  Payload ID: 17025
  Gene Symbol: SYT3
  Gene Name: synaptotagmin III
  ENST ID: ENST00000598997
  CDS Start-End: 298-586
gtagtctctaagccctcaacgggagctgggggcccggaggtgggagggggtggccgggctcccagtgggtcgcctggggtcgggcagctggctcgagtagggcaagatgtgactgttaagctgagctttttctcccggcctcagcccctagatcagacattctctctcattacccggcgcgtgggaacgggtccacagccccttgtccgccctagaacccccatgggctgccgcccgccgccgcctcggctgccacccaggacacggcagagataagcgcaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgc

SEQ ID NO: 188151 - DNA, 567 bp, Homo sapiens
  Payload ID: 17025
  Gene Symbol: SYT3
  Gene Name: synaptotagmin III
  ENST ID: ENST00000595557
  CDS Start-End: 1-240
gggcacaacgaggtgatcggcgtgtgccgtgtgggccccgacgctgccgacccgcacggccgcgagcactgggcagagatgctggccaatccccgcaagcccgtggagcactggcatcagctagtggaggtgagtaggggtcccacaccgacccctgacaagcacccgtgcaccctcggccccttcatccatgcaacgaacgccctgcatgttcgtgagtcgcagagccaggcgtcctaggtttcaatccctgctgtgccaactttagctgtgcggcttagagccagttacccaagcgctctgtgcctcaatttacccactaggaaatgggactgttgatagcatcttctgttaggatagaggtgagatgtgctgagttaaacgttctgtaggtggtcgctgctgttgttacccatgaggctaagttgaaaatagagggggctgggcgtgagccaccgcgcctggctattggcttctctctcgggtaggtgtttgcagtggcaatgagatggtcacttggagctccaggtgtataatgctgtatctgttatgataccttcggctgaa

SEQ ID NO: 188152 - DNA, 4110 bp, Homo sapiens
  Payload ID: 17026
  Gene Symbol: SYT4
  Gene Name: synaptotagmin IV
  Uniprot ID: Q9H2B2
  ENST ID: ENST00000255224
  CDS Start-End: 370-1647
gatgagcatgtgttgaatcctcaagagaggagggaggaagcaagaaggaaagcttgaagggaggaggggaggggggcaggtgctgatttcagccctgtagcgtcaggattgcgtcaattcgggttccagccacgtctggagtctcggagacgagcttctcagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcacaaaaagttaatgtgattaagatttaaaaacgaaaagtatgccttgccttgtgaaaatttatccatttatcttcaggttggggaaatcaatttttctttaaatccaaagatactaaaaaaatgtcctccagtttgtatttattaattctgtcatgtgcaaatggttgtcctgcatataaaagtatctggtcatttcagtttggtttgtaattatttgatgcaattttatcataagagtaactcagattcatttcaaaaggacagtgaacaagctgagaaattattttatcaaagggctgagttgagaacactgtggctgaaatataatttttctcccccctaaggttacatgtgagtcaaaattttgtaaaatataacctcacataagaaccatggccttggattattcactgcctgtcacaagcctcagtgtggcctgagaaatccctatgtacctttgtgaaattgttgaattagttagtgaataaagaaataaacttcaactagaaatccagttagaagtgcaattttcttataggaaataggtatagtgtgcaagtgtacttttaaggccatcgtttgtacccagagtcggcatggccacctaagtcttcatttaatttattgtcccccagaaaagattaagatgctacttgaaaagactgtgaagattttttacattgccagataaaaagtgttacttaaccaacaaacaaatgtaagactacaaaatcgttcaagagcaattctaatataatttacatatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtaatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcattttccaaacaacttatacatgctttttatgactatgcctaatgtaaagaaaatgtattacattctgtatgtacaaagattaaaaatcaacctcttttttgtgctttaaaatgactttgggattaaaaaagcatatttcccaatcattgtcttcattccactacaaagtcacctcacagcatcttgctccactcggcatctctgtgaaagcaacatgaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgatttttttttttttaacatggaacaatgaaaccaacaacaaacatttttaaaattaaaatggataatttgtaaatagtttttagcttttaaaatttaaagtgtttttgagtgtgaaaagttgagtaaaactatttgcaactggttttcagaaaagagaaaagaaacaacaaaggaattgaaacaggcagggagatcttaatacctaatttcatcatttctgaaaatgtactgttttagaatgtattacaatatcaatgtgaatatcttgaatcctgttacaaatcctgcactgtattaaacatgtaaattaattgtttgtctgattagccaatctcaccacccaaatggggaggtatacatgtttgaagaactgtgtaactcagtaattgatttgttctgatgttgtaactcaatagaagtgttttggaaggaagcatggtgtgtgagacagtgtctgttcttttgtgccagctctgtatgatgtttgtaagaccatgtttgtaagacatgaataaattgctgcttttgcccaacccgtttcaatgca

SEQ ID NO: 188153 - DNA, 1765 bp, Homo sapiens
  Payload ID: 17026
  Gene Symbol: SYT4
  Gene Name: synaptotagmin IV
  Uniprot ID: Q9H2B2
  ENST ID: ENST00000590752
  CDS Start-End: 210-1433
agaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgtctctctctttgcatggatctgctgtcagagaaaatcatccaagtctaacaagactcctccatacaagtttgtgcatgtgcttaagggagttgatatttaccctgaaaacctaaatagcaaaaagaagtttggagcagatgataaaaatgaagtaaagaataagccagctgtgccaaagaattcattgcatctggatcttgaaaagagagatctcaatggcaattttcccaaaaccaacctcaaacctggcagtccttctgatctggagaatgcaaccccgaagctctttttagaaggggaaaaagagtcagtttcccctgagagtttaaagtccagcacttcccttacttcagaagagaaacaagagaagctgggaactctcttcttctccttagaatacaacttcgagagaaaagcatttgtggtcaatatcaaggaagcccgtggcttgccagccatggatgagcagtcgatgacctctgacccatatatcaaaatgacgatcctcccagagaagaagcataaagtgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaatttttggttttggattctgaaagggggtcccgaaatgaggtaatcgggcagttagtcttgggtgcagcagcagaaggaactggtggagagcactggaaagagatctgtgactaccccaggagacaaattgccaagtggcacgtgctctgtgatggttagcatcctagccgtgagttggaacttaaaggtttttactaggcaaggagaaattttctttctttctatattggattgcaagcttgggaaatcaagctacctttttgttgttgttgttgttgctagaaatggattgaattagtagaccagaaagtaacttcaaatgtgtattatgataatttccctatttattagaagagttggataaattttcataagatattcaatatctccttcagattaccagtgatataactaggaatagtcagacattttatgaatactgtgccagaatcccaaattataaatgtgacaatctcattggaacatgtcac

SEQ ID NO: 188154 - DNA, 565 bp, Homo sapiens
  Payload ID: 17026
  Gene Symbol: SYT4
  Gene Name: synaptotagmin IV
  ENST ID: ENST00000596867
  CDS Start-End: 257-565
agaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttggtaagcaagaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatctgatgtgtccggactttcagatccctatgtcaaagtgaacctgtaccatgccaaaaagagaatctccaagaagaagactcatgtgaagaaatgcacccccaatgcagtgttcaatgagctgtttgtctttgatattccttgtgagggccttgaagatataagtgttgaa

SEQ ID NO: 188155 - DNA, 560 bp, Homo sapiens
  Payload ID: 17026
  Gene Symbol: SYT4
  Gene Name: synaptotagmin IV
  ENST ID: ENST00000593720
  CDS Start-End: 130-560
ttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaatgaaaactagagtgctgagaaaaaccttggatccagcttttgatgagacctttacattctatgggataccctacacccaaatccaagaattggccttgcacttcacaattttgagttttgacaggttttcaagagatgatatcattggggaagttctaattcctctctcgggaattgaattatctgaaggaaaaatgttaatgaatagagagatcatcaagagaaatgttaggaagtcttcaggacggggtgagttactgatctctctctgctatcagtccaccacaaacactctaactgtggttgtcttaaaagctcgacatctgcctaaatc

SEQ ID NO: 188156 - DNA, 3955 bp, Homo sapiens
  Payload ID: 17027
  Gene Symbol: SYT9
  Gene Name: synaptotagmin IX
  Uniprot ID: Q86SS6
  ENST ID: ENST00000318881
  CDS Start-End: 238-1713
cggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgacaacgtggatctgggagagctgatgttttccctgtgctatcttccaacggctggcaggctgaccattaccattataaaagcaaggaatttaaaggcaatggacataacaggagcatcagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccgtgtaggtcacaatgagatcatcggcgtgtgtcaagtaggcaacgaggctgagaggctgggcagagaccactggagtgaaatgttgtcatatcctcggaagcccattgcacactggcattccctggtggagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttgaaaaa

SEQ ID NO: 188157 - DNA, 2094 bp, Homo sapiens
  Payload ID: 17027
  Gene Symbol: SYT9
  Gene Name: synaptotagmin IX
  ENST ID: ENST00000524820
  CDS Start-End: 91-1050
gcagtcctgagctttgtcaacatgatcctcctgcctgagacttcaatttgggaaagaatgatatgaagaagccagtaatgcagagaacaaatgctggcgaaggtggtggagggagatttagctttcaaaggaggcagagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatattcttagctagcccctaagagacagcaggtgttatctgtcctccgtaccacattttctttagagctttttcaggttgtttgtgctgaatggaacctggcattctattaactgtagtctgcagctaagagaccattacctgactctgacagcagacaacgtggatctgggagagctgatgttttccctgtgctatcttccaacggctggcaggctgaccattaccattataaaagcaaggaatttaaaggcaatggacataacaggagcatcagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccgtgtaggtcacaatgagatcatcggcgtgtgtcaagtaggcaacgaggctgagaggctgggcagagaccactggagtgaaatgttgtcatatcctcggaagcccattgcacactggcattccctggtggaggtctcttggtgcccaggttttctctgcatacttgctgcactctctggtgtcctggaagcagctctgccctcttccaacctggctcagccttgaaagggccccttttttcacattggtgcaggggaggaagaagggtttccagctgcaaggagagagcagcgtgcagtgacagtgaggcaccaggatgtagaacaatgctgccagaacatattccctgaggtttgggaatgaacttcttcaagggctgtgctccctttttgatgggtcctagtgggcctctgtgctggtcgtgaccgacttttcttcaatgatccagtggaggctgcaatgtattttgcttaaaactacagctggtttataattttggcctcagacagtaattacagctgctggggctccttggagagataattacggaaagaattcagcatattcattttatctacacacttaaccatcaattaaatcattaccatctaa

SEQ ID NO: 188158 - DNA, 3183 bp, Homo sapiens
  Payload ID: 17027
  Gene Symbol: SYT9
  Gene Name: synaptotagmin IX
  ENST ID: ENST00000532592
  CDS Start-End: 18-539
gaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggacaacgtggatctgggagagctgatgttttccctgtgctatcttccaacggctggcaggctgaccattaccattataaaagcaaggaatttaaaggcaatggacataacaggagcatcagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccgtgtaggtcacaatgagatcatcggcgtgtgtcaagtaggcaacgaggctgagaggctgggcagagaccactggagtgaaatgttgtcatatcctcggaagcccattgcacactggcattccctggtggagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttg

SEQ ID NO: 188159 - DNA, 3792 bp, Homo sapiens
  Payload ID: 17028
  Gene Symbol: SYT5
  Gene Name: synaptotagmin V
  Uniprot ID: O00445
  ENST ID: ENST00000354308
  CDS Start-End: 371-1531
aaggcagaaaatgctaaagcaccaggataaacatctgtgggcgtcatcgaggttcccgggtggaggcgggaggaggggcggggcagggctttccgcctacccgagaccaaatacgggcacacacaatacacaccacacacgcgcgcacacgcacacgggcacacacgcgcgcacgggatcctgctccgctccgcggctcccccgccccggagagctccgcgatcagcacccgggacagcgccaccgcccacgtgcagggggtggggtccgggcggggctggcgcctcggcgtctcccgggagtgtcccgtccagccgccgagcagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagcagctccggtggcctgggcccatgctccttgatgggggtgggcaagggctgggacccaagaggaaacctcgtttccaggaatgggcgctcgcagggcggtgtgagtgctgttcgtcctgaaagcctctgagagactggcctgaccccatggactccctcacactctcacccgttcattcctcactcaccactctgagcctgggtttcctcctctggagaatgttgggataataataattcctgccacacgctggctgtgaggagtccgcgagaactcccttgcttgtccatgaatttatccactcgcttgctcacccatgactcacatcgattttcatacccatttctgcatccctccctccctctcttttttttcttccttccattccatattccctgaggtcttctgttgagtgctggggccccagaatatccaaacacagacctgaccccccaagcgacttactgccatcaaaacaaaggagaggcgcggagccagggaatacaatctccagagcctgcgagagaggttggagttcagcaaggaaagccaatgatttcaacttcacctctttcttttttcttttcttttttcctttttgttttctttctgtctttccttttctttctttttctcttgttttttttttgtttgtttgtttttttgtttttgtttttgtttttttgagatgaagtctcactttgtcgcccaggctggagtgcagtggcacgatttcggctcactgcaagctcctcctcccgggttcacgccattctcctgcctcagcctcccgagcagctgggactacaggcgcccgccaccacacccggctaatttttttgtatttttagtagagacggcatttcaccgtgttagccaggatgatctcgatctcctgacctcgtgatccgcccgcctcggcctcccaatgtgctaggattacaggcgtgagccaccgcgcccggcccttcttcttttcttttcttttctatttcttttcttctcttcttcttttttttaattttgagacggagtttcgctgttgttgcccagaatggagggcaatggtgcaatctcggctcaccgcaacccctgcctcccgggttcaagcgattcttctgcctcagcctcttctttcttctttttttgacagggtttctctgtgtaccctggctggagtgcggtggggcaatcatagctcactgcagcctcaacctcctgggctcaggggatcctcctgcctcagactcctgagtagctgggaccacaggcacatgcaaccatgcctagctaattttttcttttcttttcttttcttttttagagatggggtcttgctatgttgcacaggctggtttcaaactcctgcaatcctcctgtgtgagtagctgggactgtagacatgagccgccgcatctgacctcattgttctttcaacgaatgctgcctcctactctgtttctagcaaagatgatagttccattggcttctaccttatctcatcccatacagaattttgggtggtgaacaaagacctataagatttggccagagaactctctgagcagcagattaagtggagaatgaggcaaaaattacccccacgtaccaaaaaaggaggcagcaaacaaacttacttgctcctaagcttcctggtagccaatcgggaaagtgaaaatagaacagctacacagattataatatccatgagatttttaatttttctccaaaggaattcagtaacttttcatgtgtgtgagtgtgtgtgtgtgtgtgtgtgtgtgtgtgtgtgtgtgtgtggctgtagagcatgtctttatgaagacagccctttatgttactactattactgccaataataatcctcacagcaaactcatgaa

SEQ ID NO: 188160 - DNA, 2612 bp, Homo sapiens
  Payload ID: 17028
  Gene Symbol: SYT5
  Gene Name: synaptotagmin V
  Uniprot ID: O00445
  ENST ID: ENST00000537500
  CDS Start-End: 1064-2224
gggacccccgccctcagcccatccgcatccgcatccctagaggaaaggggtgtgcgagtgggggctggggcactggggagacaaccagagggagggcagcagcctgaagcggagagacagggatctggggacgcgagacaggtatggagaagacaaagagccgagggcggggagtggggcgcaggcggaggggagagggagagaccctggagacagaggccaggcgatagggaagagagacaggcgggttggggaggcagacacagggaagacgcctatgtggggtcaagaggcagcgtggagaccgaggcggtcacgagagcagcacggatgcgtggagagaccaacaggccaagaaggatgagggggctcagcacaggcaccgggcagcccccgacccgccctccagcaaaattggggagagggaagagggaacctgcgtctcagctcccaggaccaggtgcggagggagcagtcggctgtgggcgctcggaccacaggctgcccgctccccacctcgcgggacctcaggatcccagtcgggctattggggggttcccaggcaccggtgggccccggagcgagcctgccccgccgggactccgcgtctgtgcgtcagccccgcccgttgtcctggcaacaacccgttgcccgggcaaccagctttgctctcaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagcagctccggtg

SEQ ID NO: 188161 - DNA, 769 bp, Homo sapiens
  Payload ID: 17028
  Gene Symbol: SYT5
  Gene Name: synaptotagmin V
  ENST ID: ENST00000585461
  CDS Start-End: 350-499
ggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgactt

SEQ ID NO: 188162 - DNA, 640 bp, Homo sapiens
  Payload ID: 17028
  Gene Symbol: SYT5
  Gene Name: synaptotagmin V
  ENST ID: ENST00000592470
  CDS Start-End: 185-640
cgcgcgcacgggatcctgctccgctccgcggctcccccgccccggagagctccgcgatcagcacccgggacagcgccaccgcccacgtgcagggggtggggtccgggcggggctggcgcctcggcgtctcccgggagtgtcccgtccagccgccgagcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctg

SEQ ID NO: 188163 - DNA, 329 bp, Homo sapiens
  Payload ID: 17028
  Gene Symbol: SYT5
  Gene Name: synaptotagmin V
  ENST ID: ENST00000587067
  CDS Start-End: 129-329
ggggctctggtgatgggcccctctcctttcagcaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggc

SEQ ID NO: 188164 - DNA, 3619 bp, Homo sapiens
  Payload ID: 17028
  Gene Symbol: SYT5
  Gene Name: synaptotagmin V
  Uniprot ID: O00445
  ENST ID: ENST00000590851
  CDS Start-End: 186-1334
ggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggaggagaagcttggggacatctgcttctccctccgctatgtccccacggccgggaagctcaccgtcatcgtcctggaggctaaaaacctgaagaagatggacgtaggaggactgtcagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagcagctccggtggcctgggcccatgctccttgatgggggtgggcaagggctgggacccaagaggaaacctcgtttccaggaatgggcgctcgcagggcggtgtgagtgctgttcgtcctgaaagcctctgagagactggcctgaccccatggactccctcacactctcacccgttcattcctcactcaccactctgagcctgggtttcctcctctggagaatgttgggataataataattcctgccacacgctggctgtgaggagtccgcgagaactcccttgcttgtccatgaatttatccactcgcttgctcacccatgactcacatcgattttcatacccatttctgcatccctccctccctctcttttttttcttccttccattccatattccctgaggtcttctgttgagtgctggggccccagaatatccaaacacagacctgaccccccaagcgacttactgccatcaaaacaaaggagaggcgcggagccagggaatacaatctccagagcctgcgagagaggttggagttcagcaaggaaagccaatgatttcaacttcacctctttcttttttcttttcttttttcctttttgttttctttctgtctttccttttctttctttttctcttgttttttttttgtttgtttgtttttttgtttttgtttttgtttttttgagatgaagtctcactttgtcgcccaggctggagtgcagtggcacgatttcggctcactgcaagctcctcctcccgggttcacgccattctcctgcctcagcctcccgagcagctgggactacaggcgcccgccaccacacccggctaatttttttgtatttttagtagagacggcatttcaccgtgttagccaggatgatctcgatctcctgacctcgtgatccgcccgcctcggcctcccaatgtgctaggattacaggcgtgagccaccgcgcccggcccttcttcttttcttttcttttctatttcttttcttctcttcttcttttttttaattttgagacggagtttcgctgttgttgcccagaatggagggcaatggtgcaatctcggctcaccgcaacccctgcctcccgggttcaagcgattcttctgcctcagcctcttctttcttctttttttgacagggtttctctgtgtaccctggctggagtgcggtggggcaatcatagctcactgcagcctcaacctcctgggctcaggggatcctcctgcctcagactcctgagtagctgggaccacaggcacatgcaaccatgcctagctaattttttcttttcttttcttttcttttttagagatggggtcttgctatgttgcacaggctggtttcaaactcctgcaatcctcctgtgtgagtagctgggactgtagacatgagccgccgcatctgacctcattgttctttcaacgaatgctgcctcctactctgtttctagcaaagatgatagttccattggcttctaccttatctcatcccatacagaattttgggtggtgaacaaagacctataagatttggccagagaactctctgagcagcagattaagtggagaatgaggcaaaaattacccccacgtaccaaaaaaggaggcagcaaacaaacttacttgctcctaagcttcctggtagccaatcgggaaagtgaaaatagaacagctacacagattataatatccatgagatttttaatttttctccaaaggaattcagtaacttttcatgtgtgtgagtgtgtgtgtgtgtgtgtgtgtgtgtgtgtgtgtgtgtgtggctgtagagcatgtctttatgaagacagccctttatgttactactattactgccaataataatcctcacagcaaactcatgaaataaacatgatcattattcccagt

SEQ ID NO: 188165 - DNA, 580 bp, Homo sapiens
  Payload ID: 17028
  Gene Symbol: SYT5
  Gene Name: synaptotagmin V
  ENST ID: ENST00000589172
  CDS Start-End: 117-580
cactggggagacaaccagagggagggcagcagcctgaagcggagagacagggatctggggacgcgagacagggtgcttgagtgtctctgcagaaaagactccaggaccccgccaccatgttcccggagcccccaaccccggggcctccatcgcccgacacgcctcccgactccagtcgcatcagccacggcccagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgcagccagaagtagaggagctggagccagcaccatccgggccagggcagcaggtggcagacaagcatgagctaggacgactgcagtactccctggattatgacttccagagtggccagctgctggtgggcattctgcaagcaatgggattggcagccttggatcttggtggctcctcggacccctatgtgcgggtctacctgctgccgga

SEQ ID NO: 188166 - DNA, 438 bp, Homo sapiens
  Payload ID: 17028
  Gene Symbol: SYT5
  Gene Name: synaptotagmin V
  ENST ID: ENST00000590859
  CDS Start-End: 1-68
cctattacaacgaagctttcagcttcgaggtgccctgtgaccaagtccagggacggcgcctaccctagcccggcccctgttaaagttctgcagctttgcggctcttaggaggctgctcccccaggaggcgccgaacacacccgctccgcaaccgagtcctgagggttcatttccttagaaacctggctgcgcaggaagaaaggcgccagagcctcctcctcgccgcaggctccgtccctctcgtctcccaccccctcccccgtcccgagctccggggccccgagccctcgggtggcagcgagaggtaccctcagccgtgaaaacggacaccgccccttccggggcctcctcccctcacgctcctctctcctcttcctcccgcgcccaccccagaaggtgcaggtggagctgaccgtgctggactacgacaagctgggc

SEQ ID NO: 188167 - DNA, 4369 bp, Homo sapiens
  Payload ID: 17029
  Gene Symbol: SYT6
  Gene Name: synaptotagmin VI
  Uniprot ID: Q5T7P8
  ENST ID: ENST00000369547
  CDS Start-End: 251-1528
tggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgccc

SEQ ID NO: 188168 - DNA, 611 bp, Homo sapiens
  Payload ID: 17029
  Gene Symbol: SYT6
  Gene Name: synaptotagmin VI
  ENST ID: ENST00000608879
  CDS Start-End: 237-611
ggactcggggccggtgcgcgactgagctggcgcctctagccgactttgccaagagggcgcctcctgcccgatccgcgctgaccctgcgcgggacgcagccccaggcggctgcctagccgaggcgggagcccgagctgagtcgagctcgccggagcgggtgagtcccgagcccgatccccgccgggctggaccctggcgcgcagctgcggcgtctccggggagtcgcggcagggggaatggcgtgtcgcgccctggcggcgggagctgcgggagggtcggcgacgtggcggccggcccagggcacctctgtcagcctcctcgcagttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccgg

SEQ ID NO: 188169 - DNA, 1707 bp, Homo sapiens
  Payload ID: 17029
  Gene Symbol: SYT6
  Gene Name: synaptotagmin VI
  Uniprot ID: Q5T7P8
  ENST ID: ENST00000610222
  CDS Start-End: 148-1680
ggggaccctgcggggaagtgattaaaagcagagcggagccgcagggggccgctgcagggagggtcttcttggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcaggcacctctgtcagcctcctcgcagttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcag

SEQ ID NO: 188170 - DNA, 4352 bp, Homo sapiens
  Payload ID: 17029
  Gene Symbol: SYT6
  Gene Name: synaptotagmin VI
  Uniprot ID: Q5T7P8
  ENST ID: ENST00000607941
  CDS Start-End: 233-1510
aaggaccaggacgccggggttccaggagactctgcaggctccatccctccttattcccccaccccgaccccagtagcgctgggcctaggagcactcgggagttgctcagtggctctgcaccgctggcgcgggaaggggagaaaggggctgccagaggcgggaatttggtccccacgcgctgctccagggacgagaagccagggaccggcggttctgggagcagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgccca

SEQ ID NO: 188171 - DNA, 4320 bp, Homo sapiens
  Payload ID: 17029
  Gene Symbol: SYT6
  Gene Name: synaptotagmin VI
  ENST ID: ENST00000610121
  CDS Start-End: 97-312
ctgcagggagggtcttcttggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagtggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgcccat

SEQ ID NO: 188172 - DNA, 843 bp, Homo sapiens
  Payload ID: 17029
  Gene Symbol: SYT6
  Gene Name: synaptotagmin VI
  ENST ID: ENST00000608203
  CDS Start-End: 202-843
ccctataactcgctccctccgtccctctcggactcggactcggggccggtgcgcgactgagctggcgcctctagccgactttgccaagagggcgcctcctgcccgatccgcgctgaccctgcgcgggacgcagccccaggcggctgcctagccgaggcgggagcccgagctgagtcgagctcgccggagcggctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccac

SEQ ID NO: 188173 - DNA, 572 bp, Homo sapiens
  Payload ID: 17029
  Gene Symbol: SYT6
  Gene Name: synaptotagmin VI
  ENST ID: ENST00000609577
  CDS Start-End: 308-572
gtccttcccccaccccctctcgcccctataactcgctccctccgtccctctcggactcggactcggggccggtgcgcgactgagctggcgcctctagccgactttgccaagagggcgcctcctgcccgatccgcgctgaccctgcgcgggacgcagccccaggcggctgcctagccgaggcgggagcccgagctgagtcgagctcgccggagcgggcacctctgtcagcctcctcgcagttgtagttattgtgtgtggcgtggccctggtggcagtttttctctttctcttttggaagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgt

SEQ ID NO: 188174 - DNA, 1897 bp, Homo sapiens
  Payload ID: 17029
  Gene Symbol: SYT6
  Gene Name: synaptotagmin VI
  ENST ID: ENST00000610096
  CDS Start-End: 79-294
tggggccgtcgtgccccgccccagtgcggccggggcgcgggttcgagctgctgctcggcaagcctgggtgtctagggcatgagcggagtgtggggggccggcgggcctcggtgccaggaggcgctcgcggtcctcgcctcgctgtgccgggcccggccgccccctctcgggctggacgtggagacttgtcggagcttcgagctgcagcccccagagcggagtcccagcgcggcaggcgcagctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaa

SEQ ID NO: 188175 - DNA, 4424 bp, Homo sapiens
  Payload ID: 17029
  Gene Symbol: SYT6
  Gene Name: synaptotagmin VI
  Uniprot ID: Q5T7P8
  ENST ID: ENST00000609117
  CDS Start-End: 305-1582
cggggccggtgcgcgactgagctggcgcctctagccgactttgccaagagggcgcctcctgcccgatccgcgctgaccctgcgcgggacgcagccccaggcggctgcctagccgaggcgggagcccgagctgagtcgagctcgccggagcgggtgagtcccgagcccgatccccgccgggctggaccctggcgcgcagctgcggcgtctccggggagtcgcggcagggggaatggcgtgtcgcgccctggcggcgggagctgcgggagggtcggcgacgtggcggccggcccaggctgtgctggatgccctggaggaacaaggaggcctccagtccctcttctgctaatccccccttggaagccctccagagccccagcttcagaggcaacatggcggacaagctgaaggaccccagcaccctgggcttcctggaggcggccgtgaagatcagccacacgtccccagatatcccagctgaggtgcagatgtcggtcaaggagcacatcatgcgtcacacccggctgcagcggcaaactacagagccagcgtcatccaccaggcacacgtccttcaagcgccacctgccaaggcagatgcatgtctccagtgtagactatggcaatgagcttccaccagcagcagagcagcccaccagcattggccgcatcaagcctgagctctacaagcagaagtcggtggatggggaggatgccaagtctgaggccaccaagagctgcgggaagatcaacttcagcctacgctacgattacgagaccgagaccctgattgtgcgtatcctgaaggcttttgacctccctgccaaggacttttgtggaagctctgacccttatgtcaagatctacctcctgcctgaccgcaaatgcaagctgcagacccgggtgcaccgcaagaccctgaaccccacctttgatgagaacttccacttccctgtgccctatgaggagctggctgaccgcaagctgcatctcagtgtcttcgactttgaccgcttctcccgccatgacatgattggcgaggtcatcctggacaacctctttgaggcctctgacctgtctcgggaaacctccatctggaaggatatccaatatgccacaagtgaaagcgtggacttgggagagatcatgttctccctttgctacctgcccactgcaggcaggctcaccctcacagtgattaagtgtcggaacctcaaggcgatggacatcacaggctattcagatccctatgtgaaagtgtccttgctctgtgatgggcggaggctgaagaagaagaaaacaaccataaagaaaaacactctcaatcctgtctacaatgaggccatcatctttgacattcccccggaaaacatggatcaagtcagcctgctcatctcagtcatggactatgatcgagtgggccacaatgagatcataggagtctgtcgtgtggggatcactgctgaaggcctgggcagggaccactggaacgagatgctggcatacccccggaagcccatcgcacactggcactccttggtggaggtaaagaaatccttcaaagagggaaaccctcggttgtgatttcattcacgtggatgctgcaagcagagagactgccacctggagttaggatggcagggccgagctgctagcttcgacagtgagagctcgtgcccatctccgaaaccacctccaacaccatgagatgtgcagccaaataacacaaatgggactcagcaatgttctctttgcacttgttcaaccgtctaaacagtgttgtgcagtcgcagtggcggcagcagcggcagccgtccgtcactccagagtcttacctgctcctgtgtaggtcaaagctgagacacttgtcatgtggtcagatctgtcttagtcttttgtgtctcccaaggtgatgtttttgtggtttttcactttttatgggtctgctggtaagaaaagggaaaaaaaaaaagagtaggaaaagacaaagggtggaaagcccagaagttggttctagaaaatacaaggtacagttttttggaaagaggtggattgagtttctgaaatgctgcgtctccagcaagctccacaaccctggaaaaggaggaggcgtggtgggactgcggctgcattttcagtgccctgcaggaatggggtgaatccatggaagagcctttgtgaggtgaattactagtctttgaagctcttcgctggcaggacataaaccacgctgggaccctcagtcccgtgttgaaatcacaagacctctgaggcgcttgtgagccttcagctgatgtgcagggttcctcgctccccttcctcgctggctttccccatgaattgaaaacgtcttgattcctcatgggaacttagtcactttctttaggaatgattcagttcagccgaaactaaacacgccatatgttttctgatgcgccacagttaatgatcacatttgtttgaaaacaggatctttgtcctcagaaataatcttgattgtaaagtaagagagaaacatatgttctggaatgatttctgcattatacatagctttataattccatgaagtatcaagctgctgtttaaaatgcctaaacagattaaagaaaaacctagattaaatgttcttttccaaatggggagttttgaaatccaaatagcagtttgagtccatctttctatgaagagtatgtttttgattgaaaccgagtcagcgtaagcctatttcagcccctttggctctttgacaatattcatcttaaactttagttctataaattactaagtacttcagtgttgtttgtttcagtggttgtgagggtttcttgtttcctttagatctttaccttaggccaaactcagtttaggaaaaaaaaaattgtttgaactattctgtgttgtaatagcacatttctgttgagttaatagtggtcttcccaccaacccctaaaaccaggttgatttgctcaatctcagtttgtataaccccagtaagcgcatggaggtgagtttctacttcgacttgtggcgacacagtgccagtttcctgagctgtgtgtactacttgcaagaggcaagtctgctgaagaaccccttcttttaacagtggaaaatcaagaacagaaaatctgttcacacacctgtgtcttattctttatatatgctacatggtagaggagcagcgaccaataaagtatccctcattttaaaccaagttgtcagatttctctgctgatagaacgctgcatagtatcttctagccctaaaaatgaccaggttgggcatgagttaacaggatattgtggcaaaaggaattttctgcttagaaaagtaaatgtagataaacctaaactccaccctgtactgagccttaggctagggactcatgtgtaaagatgacttttctccccagatatcttgtcattgacaggccttcctagtctggtagtcctacatttgggtgttctcctgagagtgagaaaaaacccaaggtcatgacaagattcctggcaggtgacagacttcattatgattctgactctagactgaccccatcaagatagtcgtttccgtcagtgaacagatgctgaaggccttgccattacaaaggagacaactgagttccctgggtcataaggagtccagaaattagtgtgagaaggtccttctggaagtgaactcaaaattcatgtccagctgtcatcgttaaacccttaggcaggtgagtataacccattctaacctcttggagaagggagtgtgatcaatgtgaatcacaatagtattgctcatctgagacattcctcttatatccaagcagctatctcccatgagtgaacatcccagtggtttcagaaaatcatgtcctgaacagattctagccagccccacaccaccctggccaactgcaaccgctgctgctctagcagtctgggtcaattcctacaggcttgggagcccaccccagggaggcttttatctcctgcagcctcatccccagcaccctcaaggtagactactcctcagcctgaatcatgaatgaaacctgaacatctgccaacttcattatctagcccagtatctcttccctcacagagaagaagaaaatgaaatacaaagttgatccatttgttggctttctctggccggagaaacctctcgggttgttgctgtgagctttgatgaagttgtgataaccagggccatttgcacataggtttttttaaaaaacatgaaaagttcccttctcctttatttagcagtgtttccgggctgaaagacgccctcctccccctctgcgcttacccaggacgttaattaattgcactgtcatttaaaatattatgttgttaattactcgtttgtgtcttcccacccgtgtcacagcctggagtttttattcaattaaatctctgtctcttgccca

SEQ ID NO: 188176 - DNA, 4854 bp, Homo sapiens
  Payload ID: 17030
  Gene Symbol: SYT7
  Gene Name: synaptotagmin VII
  Uniprot ID: O43581
  ENST ID: ENST00000263846
  CDS Start-End: 329-1540
ccgggcgcgctcacacacgcgctcacacacacacatacacacggcctcgtacacacacacacgctccggcgcgcacacgcggcgcgcaggccggagggaggcggctcggcgctgttcggcggcggcggcagcgtgctccgcgggcgggcgggagggctggcgggcggcccccgctccccggctccgcggctaggtgcagcccgctcggcccccgccctcggacccgcccccgggggtcgcccggccccatgcccagcggcggcggcggagcagcgcgcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgtgtgcgtggggacagaggcctggaaatgcggaggactatacagagaaggcaggttttgtgaaggccaggcagggttggaggccgggggtgtgagaggagaggcccatagggctgagtggggtcgggtgaggcagaggtcagaaacagaagagctgcagttgctggagctgggctgagaactgggctgcctcctgccatccccccgtctcctccccttctccccttggtgcccccctctgctcagaatctgaagtagttccctcctcagcaatttcatctcttgaacactgactcacaccttttaggcacctactgtgtgcatagcattccaccaggactcatctcccttccttctcagggggtcccgagccccgactagctttgccctaactccttcatcaaaagaccccccgccagcttcccacacctcatacgcagccacatctgccctattctccatgctttccagcttgcctgcccttcctcatctctccctgcctgtgcagacctccacccttctttcctccacccctccatcccccaatgcttgtagaccttccattcattccgtctcatcgtgcgtggtctctgatcgtccatcacctgaccttctccaggactgtcttctcacccttccccactccctggtccccgggagcagctccttctgcccgactcactcacagtgcagggaaaggaggcagggaaaagaccaggattctgtgagttctgaggttgccacacacaaagaagctgtggtttctctgcctcggccactgatgagactaaaactggcttccccttggagacggcagatttcaggctgatccctgcttaagccctctcatccccacgctggtcctggtattgatacaagacccagctggtgacaaagcctccaatcctgggggtccacgagcctgggcctgacattcccagaactaccgccaggtggcgccaggcccccacagtctgtggccgtggtcttagcccccagttccactctggatgggcctgtgacaccccaaagagaagaaggggactctggatagggtccccacatccagggcgtggggagaccattggcatttgggaaccattttccttcgaacggcttccccttgagctgagcattctgcttgctgcagtagacgggtcgccttttgcccataccgaaattttctgaaattaaatcgcacacccccaccatttcctctccctgggatctggaggaacatcatacatagtaggtgaatcgttttgtagagtgaagaatgctaatgtaaagcaaatagtcacccacgttccttgtaaatccaaatgtttctatattgtagctttgcttaaaatggggtcggccccaactgcatcctcctctttggcgggctggggagcggcccccagccgggacgggagggcagcgaccccgaggcctcgtggacgtgggagagagtgtggtgggaagtcttgagcggaggaggggatctgcccttctccactcctctcttggatccgcctcggtttcctgtccccccaccacccgcctgccccgcggaagaccgcccagtgagccagcccccaccttccaggcgccttcgccctggggatccaaccaacttgtatcgagtgggcggggcaacggctccccatttttcccgagccccgcccacagagctcttagccaatcctatgcagagagcatctcctggcaggggtctcttcccaaccagaccccacccaggcacattagcgaccaggcttgggcttccccagcgccccaccaccaccacgtgcaggtggagctctgggatgctatgttggggcggcaagcggtgggccgagggccgggtaggctagcacgggaggtaagggtggtatgggatggggcgggggcggtctagggcaataggagagcagagaatgggggaacttgagggtggggggagggcaccggagccttgccaccatcccaggactttgggcaagtcacccgcactccctgggcctcggtttccccatctgtaaaatgatggtaataatacttcacctacctcataggggaggttgtgaggccaccatcacctgacctgggggtcaaggcaggaggactccgaaggtgctacccgtgagcaaagtgtaattaccgaatcctgactgcaaggcccacctgcccctcccccacagagcctccagagctagctgaggccaacgcaggcccatccgtctcttcactctgtcgcaggccctttcatgggcttcgtctgccatctttgtgggtgccctagacttagtccttatcttgtcctggtttcctttcttgtgaccatctccccatgaaagtgctgtacaaattccacccgccccaggacccccgcacctgccctctggcaccagatgccagggaagggacagaggaaaacagccacaaacaagccaggggggctccccggagccccaggggtggggattggtggccactgtttgtatgttcttgagtgcaagtgttttataaaaaataaaacaaaaacccaccatcacaaaaaaaaaaattttgcagcgaagagaaatgaagaaaaactgaagaaaaaaaaaaaacaggaaaaaaagaaccatacaaaatttttccaccacacataccctctaagccagcaagatttcctctttgcaaaatcatatttttgtgggaatgggccctgctttttgtggcaaggcctgttctgattaataaaggatcgtgaaaaagta

SEQ ID NO: 188177 - DNA, 1621 bp, Homo sapiens
  Payload ID: 17030
  Gene Symbol: SYT7
  Gene Name: synaptotagmin VII
  ENST ID: ENST00000535826
  CDS Start-End: 53-1621
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 188178 - DNA, 1961 bp, Homo sapiens
  Payload ID: 17030
  Gene Symbol: SYT7
  Gene Name: synaptotagmin VII
  ENST ID: ENST00000539246
  CDS Start-End: 1-369
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaacccgctcttcctccgtcgttaacccttcgttgtcctgtgggatagagttggaggtggctgccctcccccaacccccgccgcccctgccccaggcggtggggaggggccccccctccgttgtcgtgtttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 188179 - DNA, 2061 bp, Homo sapiens
  Payload ID: 17030
  Gene Symbol: SYT7
  Gene Name: synaptotagmin VII
  ENST ID: ENST00000539008
  CDS Start-End: 1-2061
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 188180 - DNA, 2186 bp, Homo sapiens
  Payload ID: 17030
  Gene Symbol: SYT7
  Gene Name: synaptotagmin VII
  ENST ID: ENST00000539468
  CDS Start-End: 1-369
atgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaacccgctcttcctccgtcgttaacccttcgttgtcctgtgggatagagttggaggtggctgccctcccccaacccccgccgcccctgccccaggcggtggggaggggccccccctccgttgtcgtgtggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 188181 - DNA, 578 bp, Homo sapiens
  Payload ID: 17030
  Gene Symbol: SYT7
  Gene Name: synaptotagmin VII
  ENST ID: ENST00000545053
  CDS Start-End: 53-578
gcggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtca

SEQ ID NO: 188182 - DNA, 1887 bp, Homo sapiens
  Payload ID: 17030
  Gene Symbol: SYT7
  Gene Name: synaptotagmin VII
  ENST ID: ENST00000542670
  CDS Start-End: 52-1887
cggccgcgggcggctctgaggagcccggagggaaccggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaatttcgaggactccaccctgtccacggccactacccttgagtctatccccagctccacgggagagccgaaatgccagcgaccccgcaccctgatgcggcagcagagcctgcaacagccgctgagccagcaccagcggggccggcagcccagccagcccaccaccagccagagcctgggccagctgcaggcccacatggcctcggcaccaggccccaacccccgggcctatggccggggccaggctcggcagggcacctcggccggctccaagtaccgggcggcagggggccgcagccgctccaacccaggcagctgggaccacgtggtggggcagattcgaaaccgaggcttggacatgaaatccttcctggaaggccggatggtggtgctatccttggtcttagggctttcggaacaggatgactttgccaatatccctgacctgcaaaacccaggaacccagcagaaccagaacgctcagggggacaagaggttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 188183 - DNA, 2013 bp, Homo sapiens
  Payload ID: 17030
  Gene Symbol: SYT7
  Gene Name: synaptotagmin VII
  Uniprot ID: O43581
  ENST ID: ENST00000540677
  CDS Start-End: 7-1443
gggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatggcaccctcctgtcgggcgccaaagtggccgccgcggcggggctggcggtggagcgggaaggccggctgggggagaagccggcaccggtgccgccacccggagaggacgccttgagaagcggcggggctgcccccagcgagccgggcagcggtggcaaggcggggagaggccgctggcggacggtgcagagccacctggccgcagggaagctcaacttgtccaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctgagtggggccaagggaggcccagggggccgagggcccaggtccccatcatgccctcaccactttatgcacaacgcccggcctgagccccctgccatagggaggggaggaccctgagggctcagccagggaggggtcccaggactcaactgggccccgtttctaggaagtaccagccccatcccccacagtccagctccggggaaggggctctgggaggcattttcctgctttgccccttttcttcctgacttactaatactaaagaagttgggggagctcgagagccagacggccagacaggcagacccctccagaggcccgccaggtgggcatggtcccccattttctttaaggcagcacctggagtggagagaggccactccctctccagcccccgatgtggacccggggaggggaggctgaggcgtttggccccggcctggccaggagaggcccatccccagggcagtttcaggtgccggctgggccctgaatgtcgaggatagtatatagcccgctcctgggtcctggagctgtggccctttgtactcgtgttgtgtccattgtgtgt

SEQ ID NO: 188184 - DNA, 1362 bp, Homo sapiens
  Payload ID: 17030
  Gene Symbol: SYT7
  Gene Name: synaptotagmin VII
  ENST ID: ENST00000542836
  CDS Start-End: 19-1362
accggcgacgaggggaccatgtaccgggacccggaggcggccagcccaggggcgccctcgcgcgacgtcctgctggtctctgccatcatcaccgtcagccttagcgtcactgtcgtcctctgcggcctctgccactggtgtcagcgcaaactgggcaaacgctacaagaattccttggagacggtgggcacgccagactcagggcgtgggcgcagtgagaagaaggctatcaatgatctagacagagacttttggaataacaatgagagcacagtgcagcagaaatggagctcctaccctcccaaggagtttattctaaacatttcaccctacgccccttatggcgacccacgactgtccctcaagttgcctgcaggagggaaggcggtgaacacagcccccgtgccaggccagacaccccacgatgagtccgaccgccggaccgagccacgttcctccgtctcagacctcgtcaactccctcaccagcgagatgctcatgctctccccaggctccgaggaggatgaggcccacgagggttgcagccgagagaacctgggccggatccagttcagtgtcggctacaacttccaggagtccacgctcaccgtgaagatcatgaaggcccaggagctgccggccaaggacttcagcggcaccagcgaccccttcgtcaagatctacctgctgcccgacaagaagcacaagctggagaccaaggtgaagcggaagaacctgaacccccactggaacgagaccttcctctttgaaggttttccctatgagaaggtggtgcagaggatcctctacctccaagtcctggactatgaccgcttcagccgcaacgaccccattggggaggtgtccatcccccttaacaaggtggacctgacccagatgcagaccttctggaaggatctgaagccatgcagcgatgggagtgggagccgaggggagctgctcttgtctctctgctacaacccctctgccaactccatcatcgtgaacatcatcaaagcccggaacctcaaagccatggacatcgggggcacatcagacccctacgtgaaggtatggctgatgtacaaggacaagcgggtggagaagaagaagacggtgacgatgaagaggaacctgaaccccatcttcaatgagtccttcgccttcgatatccccacggagaagctgagggagacgaccatcatcatcactgtcatggacaaggacaagctcagccgcaatgacgtcatcggcaagatctacctgtcctggaagagcgggccaggggaggtgaagcactggaaggacatgattgcccgtccccggcagcccgtggcccagtggcaccagctgaaggcctga

SEQ ID NO: 188185 - DNA, 1556 bp, Homo sapiens
  Payload ID: 17031
  Gene Symbol: SYT8
  Gene Name: synaptotagmin VIII
  ENST ID: ENST00000341958
  CDS Start-End: 303-1466
cagggactaggctgcccaggccctgcctgcttggctggggctgggggctgctgggaggtggctgggaggctgggcctgggcagctaagctggagctttggccagggtccagagcctccctcccttcagcttcctgctgcacagaaccctcgcccctggccaccccgtgctgcctccttgccctggcagacccagcactggctgctgctagtcagatggggtagcgggcaggggccggaggggccaccctcccagctgacccagcctcctgggccgcttcttccaaaccagcagggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggtgcctgcagctctccctggagttcgactttggaagccaggagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgcca

SEQ ID NO: 188186 - DNA, 1424 bp, Homo sapiens
  Payload ID: 17031
  Gene Symbol: SYT8
  Gene Name: synaptotagmin VIII
  Uniprot ID: Q8NBV8
  ENST ID: ENST00000381968
  CDS Start-End: 129-1334
gcccctgccaggaatgcacctttagcccaggcctgctcagtgagctccgccgacagccagccctgctcctcccgccatgaccctgcagacccctctgggcttccaagttcctgggggctgcagtgaacatgctccacctgcatggctggcaaaccatgcagggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggtgcctgcagctctccctggagttcgactttggaagccaggagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgcca

SEQ ID NO: 188187 - DNA, 1291 bp, Homo sapiens
  Payload ID: 17031
  Gene Symbol: SYT8
  Gene Name: synaptotagmin VIII
  ENST ID: ENST00000381978
  CDS Start-End: 1-1201
tggcaaaccatggtgggccccagctgtgggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggtgcctgcagctctccctggagttcgactttggaagccaggagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgcca

SEQ ID NO: 188188 - DNA, 482 bp, Homo sapiens
  Payload ID: 17031
  Gene Symbol: SYT8
  Gene Name: synaptotagmin VIII
  ENST ID: ENST00000417052
  CDS Start-End: 184-482
ggactgggggcacctttgcagatgtgtgcaatatcacccacactctcagaggattccagacacacaccactcagaaatgtgggctaggagcacccgctgcacctgcgctgagagagctgcagaaagggttaccagcccctcgggtggaaggagacagccggagctctcaggcagggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccggggga

SEQ ID NO: 188189 - DNA, 575 bp, Homo sapiens
  Payload ID: 17031
  Gene Symbol: SYT8
  Gene Name: synaptotagmin VIII
  ENST ID: ENST00000430303
  CDS Start-End: 269-575
gtgcccgtcagggtgatggttgaagtcctcactactcagatggtcggaggagggggtaggacacccagtcagctgccggacactcaggggactgggggcacctttgcagatgtgtgcaatatcacccacactctcagaggattccagacacacaccactcagaaatgtgggctaggagcacccgctgcacctgcgctgagagagctgcagaaagggttaccagcccctcgggtggaaggagacagccggagctctcaggggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagc

SEQ ID NO: 188190 - DNA, 1506 bp, Homo sapiens
  Payload ID: 17031
  Gene Symbol: SYT8
  Gene Name: synaptotagmin VIII
  ENST ID: ENST00000424556
  CDS Start-End: 236-625
ggctgggcctgggcagctaagctggagctttggccagggtccagagcctccctcccttcagcttcctgctgcacagaaccctcgcccctggccaccccgtgctgcctccttgccctggcagacccagcactggctgctgctagtcagatggggtagcgggcaggggccggaggggccaccctcccagctgacccagcctcctgggccgcttcttccaaaccagcagggtagaaagatggggcacccaccagtctctcccagtgccccggccccagctggcaccacagctatacctgggcttattccagaccttgtcgccgggaccccctcctggcctctaccccagggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggtgcctgcagctctccctggagttcgactttggaagccaggagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgcca

SEQ ID NO: 188191 - DNA, 4461 bp, Homo sapiens
  Payload ID: 17032
  Gene Symbol: SYT10
  Gene Name: synaptotagmin X
  Uniprot ID: Q6XYQ8
  ENST ID: ENST00000228567
  CDS Start-End: 298-1869
actccatgccgggtctctagttccagcgcgcctcggctcgctcgcgcggcgggagagttggcgcaaacctcgcggcagccgcagcctcctcgcgcgcctctccttcccctacgccctccgctcccgccatggggccaacgtggggctcctaagagttgccggctctcagcggcgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacagatatttcagtcagcctgttagctgtcgttgtcagcttttgtggactggccttgttggttgtctcactttttgtcttctggaagctgtgttggccatgctggaaaagcaaacctgtgacttccaacatcactacgcttccacagagcatttcaagtgctcctactgaagtttttgagactgaagagaaaaaagaaattaaggaaaatgaaaagccagccgtaaaagctattgagcctgcaataaaaatcagccacacttcccctgacatcccagcagaagtccaaactgctttaaaagaacatttaattaaacatgcacgtgtgcaaagacaaattactgagcctacgtcatcaacccgccacagttccttccgaagacacctgccgaggcaaatgcaggtttccagtgttgattttagcatgggcacagaacctgttttacaacgaggagaaacaacaaccagcattgggaggataaagccagaactctacaaacagaaatcagttgactctgagggcaaccaaaacgaagatgtcaaaatctgtgggaaacttaactttaccctccagtatgattatgaaaatgaacttctagttgttaaaattatcaaagctttagatctccctgctaaagacttcacaggaacttctgacccttatgtgaagatgtatcttcttccagataggaaaaagaaatttcagacccgcgtgcacagaaagactttaaatcctctatttgatgaaacttttcaatttcctgtagcatatgatcaactaagcaaccgaaaactacatttcagtgtgtatgattttgacagattttctagacatgacatgattggggaagtgattcttgataatttgtttgaagtctctgatctctccagggaagccacagtatggaaagatattcactgtgctaccacagaaagtatagacctgggtgaaatcatgttttccctttgttacctaccgacggctgggcgtatgacattgacagtcattaagtgcagaaatctgaaggcgatggatattactggctcatcagatccttatgtcaaagtgtccctgatgtgtgaaggtcgaagattaaaaaagaggaaaacaactacaaagaaaaacactctaaaccctgtgtacaatgaggccattatttttgacatccctccagagaacgtggaccaggtcagcctctccattgcggtcatggattacgatagggtaggacacaatgaggtcataggagtgtgcagaacaggactggatgctgagggtcttgggcgagaccactggaatgaaatgctggcctatcatcgaaaaccaataacgcactggcacccattgctggagttacctggccgggcgaccagttttgatagtcaaggatcctgcccttctcctaaaccaccttccacaccataatgcctccaaaatgagaccatgatattaagcatctaggatcacgtgctcattgaatcagaaaaaaagtggaaggtttggtttcctcatttgaaatatatccgtactaatgaacaaacttgatgtgcacttttttatttgcttttattgttgattttttaactttgaacatcaatacattttacttgaatacatatagtccttagttgcataaggcattttatccttcgtatcaaatgcctgttagcacaaagagtgttttactatgttgtaattctttgcatatgaaatgtttttttaaacagttcatacttacctaaaattaaatatagtttatgctgctattgtataaagtagcacatgtcatatatgtatgggtttgattttgttatactgtgttcatttctagttgtgcaggtggttctgtataaacttaaaaggagattttgaacttaacttacacaacattaaatccttgcacaatcaaattaatgttacttatctgataatacttttctttcattctcagaaaattactttcttggtgaggtttggctctgctaaactcaaaacttgtctctcaagcttgttctttaaaatacatagacaaagctgtaaatttaaagaatcattttgaatataaatttaagaagtaatacttattggctgaaaaacggaggctgagccattgtggctaccattttacactgttttactgtaacattagctcaaatatctgttgcactgttcaactgatatttttaaaattctaataatcttcatctcaaatgtagcattagtatttctaagtgaacagaatcagaagttaatttttaagtgtttgtaaggttctcaagtactgtgacatgtatttttttgtgacgtgtattttttgtgacttgaagctatcatatagatcctgtatttctgatagaccatactaacagacaccaaaggaacaacaacactgtctgtgttcatcaccgtttagattgtacacagtaatggtgactcttaaacccagtcagaagctcatcattggaattcagtattttcttaaagaaaggatgatttattttcagcaacatatagaaatatactataaatattaataatacaacttcaatgcttaataataataaacaaattaattctaaaggcccaggcctccagtccttgcatgaaaggcatttgccttcataaggatcaaggttcaggccactacatgtaaaaactatgcaagtgtttttacaagacagaactttcttttaagtcaggtcaacatattttgtcccattttcaggccctgttggaaggtatctatactgaattaccccaaccttacttttaagatgtgtggtatagatagtatatatttcaagcttatttcaaaattggtggtttttttaaaaaaagaggcaagaaaataaaaacatatttacctggatgagaaaattttatcagcggttatgaaatttttatttttgtaaaatcccattatttctaaatattaaaaaaaagttttaaaagccttgaaattttgttgacatctcttatagtgatggcattactgttaattaagaggtaaatattttgcacattaccattttaaaggcaaacacagttctgcctcagatttttcaaaaatgcttataccaccctaaggaaaacaggtactcctagctaacattttctcattgaaaataatagaagaaagctgtttggaaacatttggctaccttgtcgagcctaaaagaattatttgctataggtaaaatgaaagatgacacttgcattttgaaattatttgttttattgggaaataaaacttttcaaataggaagacaaaaagttatactattaatagaatgacatttttggagacagttgttttattagtagatataactgcagcttaaagtaaattagcaattacgtttcctaagtgagtataattattttcacccaaaaacacatttttaaggactttttgttgattcttagaaactcgcttttctttactccctaaggagaaaaagccaatgcttgtgatgaaaaaatgtgaaccattggccaatcagaagactctaatatgggaattgtagattaaaataagttttaaaagaattttttaaatgtttccttgaagttagaataaactcatcatgcaaggatatgtgttaatcctgagaaagagatcagcgagaggaaattcaccacaactcatctttcatgtaattcaggaggtaggtttatgctcagattaataaggcatgattgttaaaaatgacagttcatattattaaaatgtaatcctaacaattttaatacaacacaccctcactctacacagcccacacattcatatacacataacttaccatctttctgcttgtaattgaagatgaaatattttcagtttcagtatttaaaataagatttgatattacaaatccccttatttgtgtgggacatcacattttaatgacagtactgacacattatgaagctgcagttcaggtatataatgaacatctaatttcagggacttcttcagggacttaccaaatatcagtctaggaaaaaaaagagtaa

SEQ ID NO: 188192 - DNA, 2433 bp, Homo sapiens
  Payload ID: 17032
  Gene Symbol: SYT10
  Gene Name: synaptotagmin X
  ENST ID: ENST00000539102
  CDS Start-End: 125-709
gcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacagatatttcagtcagcctgttagctgtcgttgtcagcttttgtggactggccttgttggttgtctcactttttgtcttctggaagctgtgttggccatgctggaaaagcaaacctgtgacttccaacatcactacgcttccacagagcatttcaagtgctcctactgaagtttttgagactgaagagaaaaaagaaattaaggaaaatgaaaagccagccgtaaaagctattgagcctgcaataaaaatcagccacacttcccctgacatcccagcagaagtccaaactgctttaaaagaacatttaattaaacatgcacgtgtgcaaagacaaattactgagcctacgtcatcaacccgtggttggggaaagaagaagaagaaaagaattttgagcacttgcaattttgtcactatgccaaggcacccttcctgataatccttcaccaacctgcatgaaagtttctgaagaccacagcatgttgaaaaaaagaaaatgtactcatttttggctgccacaactatatattctttttaaaaccacagttccttccgaagacacctgccgaggcaaatgcaggtttccagtgttgattttagcatgggcacagaacctgttttacaacgaggagaaacaacaaccagcattgggaggataaagccagaactctacaaacagaaatcagttgactctgagggcaaccaaaacgaagatgtcaaaatctgtgggaaacttaactttaccctccagtatgattatgaaaatgaacttctagttgttaaaattatcaaagctttagatctccctgctaaagacttcacaggaacttctgacccttatgtgaagatgtatcttcttccagataggaaaaagaaatttcagacccgcgtgcacagaaagactttaaatcctctatttgatgaaacttttcaatttcctgtagcatatgatcaactaagcaaccgaaaactacatttcagtgtgtatgattttgacagattttctagacatgacatgattggggaagtgattcttgataatttgtttgaagtctctgatctctccagggaagccacagtatggaaagatattcactgtgctaccacagaaagtatagacctgggtgaaatcatgttttccctttgttacctaccgacggctgggcgtatgacattgacagtcattaagtgcagaaatctgaaggcgatggatattactggctcatcagatccttatgtcaaagtgtccctgatgtgtgaaggtcgaagattaaaaaagaggaaaacaactacaaagaaaaacactctaaaccctgtgtacaatgaggccattatttttgacatccctccagagaacgtggaccaggtcagcctctccattgcggtcatggattacgatagggtaggacacaatgaggtcataggagtgtgcagaacaggactggatgctgagggtcttgggcgagaccactggaatgaaatgctggcctatcatcgaaaaccaataacgcactggcacccattgctggagttacctggccgggcgaccagttttgatagtcaaggatcctgcccttctcctaaaccaccttccacaccataatgcctccaaaatgagaccatgatattaagcatctaggatcacgtgctcattgaatcagaaaaaaagtggaaggtttggtttcctcatttgaaatatatccgtactaatgaacaaacttgatgtgcacttttttatttgcttttattgttgattttttaactttgaacatcaatacattttacttgaatacatatagtccttagttgcataaggcattttatccttcgtatcaaatgcctgttagcacaaagagtgttttactatgttgtaattctttgcatatgaaatgtttttttaaacagttcatacttacctaaaattaaatatagtttatgctgctattgtataaagtagcacatgtcatatatgtatgggtttgattttgttatactgtgttcatttctagttgtgcaggtggttctgtataaacttaaaaggagattttgaacttaacttacacaacattaaatccttgcacaatcaaattaatgttacttatctgataatacttttctttcattctcagaaaattactttcttggtgaggtttggctctg

SEQ ID NO: 188193 - DNA, 5240 bp, Homo sapiens
  Payload ID: 17033
  Gene Symbol: SYT11
  Gene Name: synaptotagmin XI
  Uniprot ID: Q9BT88
  ENST ID: ENST00000368324
  CDS Start-End: 254-1549
agaaggcggagcctacctctcatcaggaccagtctgactgcacctgcatccttagctcagcgcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcagaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccatgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 188194 - DNA, 4534 bp, Homo sapiens
  Payload ID: 17034
  Gene Symbol: SYT12
  Gene Name: synaptotagmin XII
  Uniprot ID: Q8IV01
  ENST ID: ENST00000393946
  CDS Start-End: 1163-2428
gaagttctagaaaatgttaattgggggagctgtggctggcagagaaggaaaaaggaagctgaagggcacttgggctcataatggtctctccaaccctgatcctgtcctttatggacatttggcagcgctgctgccttgaggtgccttgcaatgctttatctttttgttaaagccacctctgttgcttcagccagcttgagcggttttctgttacttgctagtggttgggaaggcttagccgacgaagggaaaatgagtcaggtcctgaaggatgagcaagttacgggagtgggccgcatggtgagggagtggacttcctgatggggttaagggcgcctgaacacctgggaggcaagttgaggccaagacctggggtgatggagaggcagggtaggctacccagtgagtaggaggccgaaggaaccacagcagggctccagatctcctggcccagaggggctggtacgggaagcccagaagacactcatccctaaggggagcctgagactgaggaactctcatgccctgcgtcgggctcgtgggcgaagggccttcccagggactgcaccatggcctgtccccagccttacccaggggcctccctctcaggttctgaaggacccaggggtcacagctgtgtggggtgctccactgaacacttccttcaaactccttcaggctggagtgcagtggcgcgatctcagctccatgggagagagtttgaaaggatgaagagtttacatcctctggaaagaagcaaatagaaggcattccaggcaaaaggaactgcatcgagtaaaagcatggaggcaagaaagggcttggtgtgtttgagaaacagtgagtagggcatggtggtggcagaagcttaaagtgtatggcccgtggacagtgacagccggacaagaagctgaagtgacagaacaagttgaaccaaaggaattccagacctgggaaagtggagaaagaattttggggtcagagccgtttaagactttgcctagggcctgggtcttctttctcctaaaggcctcaacccacagcacgccacacaaatatgtcacataacacacaaacaaacatcatatttcacagtccaggaaatgaaatgaagacaaaagcgccccctgtgggtgaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcctcccggtaggccagctgccgagctgggctatgttctggaacccagtgaatcttgggggccaggcactgtgctaggcaccagcaggggtaacacgaagaagacccggcccttagggcatcaggaagactagctcccctgccccggaggatctgctcagtgctgatggcagcccagctgtgtggactcagggggctctgagggctagggaaacaggaagggcctctttgacaaggtaggagctgtgcttggaggggcaggaaaagaactgagcatgtcgcaggcagcgggcccagcctgagcaatggcaggatgtgaacttccccatcgcaaatgcagttctcagcccactgcagtggatacaaggaagggcctttctcggggccggagaagagaccaagagaccaggcccgggcagcagcctaccggccacgtggaacactggctccggagttattctctgtcaaatctactccccggacctcaaccatggcaagaaccagaggtccaaagaggcccagacccaggtccttgtgctcagtcctgcgcaaaccaggcccagaccctgcaagcatttgttgatgcccttgcaggcccactgggagaaagatgcctcaggcaggtctcagcctgggggtggcaggggtggggcagagagaatactgacagcagaggtcttggtgggctgcacgtgcctgcgaagatgtggtggacaaggaggctctcgggctgggccttggaggggtggcagcggaaggacagcccaggtggctgaggcctgatgggaagccggggaaggccagggtggaagggcggcttgagggacgccaggagaagactgaatgccaggctaggaaggaggcggctctcgatcacggggtgggtgcccccgacaccgggtctcctagcttgagttccctagaagcgaaatctgagagggggattctggggcaagtagtttcttgcgggtgagtgttctcagagaaacttaccagatcaagaaagggagctcaggctggatggaggaagccacgcaagtgtggcttcaagatccatcgccttggcctgatcgctgtgggggcaggggcctggagtacgaggggcaccctgggggctcccacccagaagcagaggggctgggctgttgcacctctactggcatcagtctttggttaccccccagccccagtaggaggagagcaggcagagcttgtcatccccagcctggtgtcccgcagtcccaggaagccgcttcttgccttcatggctgagtgctgggaagggctgagctcacccaggccagcaggtggggtatcatctgctcggtggggccacccacaggtgacagcatggaccctcaggctggctgcccctgttccttggtccataactggtgagctatggagacccaggccaacaaattatccccagtgatatggggggaggaggggctagaacaagggcccaggggactggaggcaggatggtggctttccctacctgacacagccatggcccagccccaaggccaggctgtctaccctatggccacagcaggaggtcagcccagggccaggagacacatggctggacaaggctttgcagcctgggagaccccgactttctctaacccagtggctgtgcggtgcaggccactgactccccccctgccctctcccctctctccctccccctaactgcatgacatgttaactgtgtgcccaggacagccgtggtggggaccgggtatgccaactggaatgattctagaaccaaaataaagttggggcaggaagagggggcttccagggagccctgctcggccctgaatcaccttcgtctcttctctaggaa

SEQ ID NO: 188195 - DNA, 1678 bp, Homo sapiens
  Payload ID: 17034
  Gene Symbol: SYT12
  Gene Name: synaptotagmin XII
  Uniprot ID: Q8IV01
  ENST ID: ENST00000525457
  CDS Start-End: 231-1496
atgtaaaaaatggagtcaccacgaccagattaggccacggtgaggactgagatgatgttgtaaggcaccagcacagagctgacctacagctcaatcgtggtgggagggagtaattatccattcagaaaaggggaaactttccgctgcgcctcctgtcgctgttttccttggctcccggaggtgcgcagtatcgggtccgtttttaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgt

SEQ ID NO: 188196 - DNA, 593 bp, Homo sapiens
  Payload ID: 17034
  Gene Symbol: SYT12
  Gene Name: synaptotagmin XII
  ENST ID: ENST00000533427
  CDS Start-End: 300-593
attcacaccctcactgaaatctcagctccctgggaaaggatgtcgtgttaaagggagaggaaagaacagacagcgtgggagtctggggtctgagctgggccagccatggaggtgatggggcccccgacagccagaggccagatgcagcttgaggctttgtcccgtaccacgcctgttgtgctgtggggtgtactttgccatgcataccttgctcgcgtgctgcgggcattggctgtcccagcttggccccactcttgcaaagtcagcttgtgccagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctc

SEQ ID NO: 188197 - DNA, 1661 bp, Homo sapiens
  Payload ID: 17034
  Gene Symbol: SYT12
  Gene Name: synaptotagmin XII
  Uniprot ID: Q8IV01
  ENST ID: ENST00000527043
  CDS Start-End: 140-1405
actgcaggggtggcgttgccgccggcggccgggctaggcgcaggtgcgtgcgcgctgcgggaggcgggccggcagctggagcccagccggagcggcggcccctccgcggagcccggtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactacaggtaccttcagcagaagtacggcgagagctgcgcagaggccagggagaagagagtgcctgcctggaatgcccagcgggccagcacgcggggaccacccagccgcaaaggcagtctcagcattgaggacacctttgagagcatcagtgaactggggcctctggagctgatgggccgggagttggacctggccccctatgggaccctccggaagtcccagtcggccgactccctgaactccatctcctccgtgagcaacacctttgggcaggacttcacactgggccaggtggaggtgagcatggagtacgacactgcctcccacacgctgaacgtggcggtgatgcagggcaaggacctcctggagcgggaggaggccagcttcgagtcctgcttcatgcgcgtcagcctgctgccggacgagcagatcgtgggcatttctcggatccagagaaatgcctactccatcttctttgatgagaagttctccatccccctggatcccacagccctggaggagaagagcctgcggttttctgtatttggcatcgatgaggatgagcgcaacgtcagcacgggggtggtggagctgaagctttctgtgcttgacctcccgctgcagcccttcagtggctggctctatttacaggaccagaacaaggccgccgatgctgtgggggagatcctgctctccctcagctacctccccacagccgagcgcctcaccgtggtcgtggttaaggccaagaacctcatctggaccaacgacaagaccacagcggaccccttcgtcaaggtgtacctgctgcaggatgggaggaagatgagcaaaaagaagacagccgtgaagagggatgaccccaacccggtgttcaacgaagccatgatcttctcggtgccagccattgtgctccaggacctgtctctccgcgtgacggtggctgagagcagcagcgacggccgtggggacaacgtgggccatgtcatcattgggccgtcagccagtggcatgggaaccacacattggaaccagatgttggccacgctgcgcaggcccgtgtccatgtggcacgctgtccggcgaaactagcaaccagggcgggccagttgggcaatggagctgctggagcccggtacccactcagctctgtctgatgccctctccatagcccagctggagccgtgaacactggggtcccctggcagagtcctcatgacccatcctggtctctctgtccagattgcagcagaggagtgggcgtggctctgtgtccagggccccagggtctgctcctgctgaggaccagctgtggctgggccaggacagaggactcaaccctgctcct

SEQ ID NO: 188198 - DNA, 5144 bp, Homo sapiens
  Payload ID: 17035
  Gene Symbol: SYT13
  Gene Name: synaptotagmin XIII
  Uniprot ID: Q7L8C5
  ENST ID: ENST00000020926
  CDS Start-End: 113-1393
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagataattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtgtaagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctctctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccagaaagtgccagaagcatcgtggcatttccagaaccatggattctgcctttggacccctctctattaatattaaaactctgggccttcagatgtcaccctaatccacttccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaatctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttgggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatggcaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgattccacctcttgcaccaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggt

SEQ ID NO: 188199 - DNA, 557 bp, Homo sapiens
  Payload ID: 17035
  Gene Symbol: SYT13
  Gene Name: synaptotagmin XIII
  ENST ID: ENST00000528101
  CDS Start-End: 1-557
gacaaagcttggcggggaggggacagcagacgcgttggaggacaggtcaaggagtcaaaaagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtg

SEQ ID NO: 188200 - DNA, 1710 bp, Homo sapiens
  Payload ID: 17035
  Gene Symbol: SYT13
  Gene Name: synaptotagmin XIII
  ENST ID: ENST00000533332
  CDS Start-End: 1-61
cctggagaaggcgaagcccagcttgctcgggtctgcacaacagagcatctgttacatatgaagtttacagaggtggtggccaaagggctttgtgatgtgactgctgaaataatgcaggggccacctacaagaaggaaatctctagcctaaaaaagcaactcagaatgtggagtgggatagcctgcaaatcacttgtcacttaaggtgacggcccagagaggtgaaatgacctgcccaaagtgacccagctccagcggcaggttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaag

SEQ ID NO: 188201 - DNA, 5094 bp, Homo sapiens
  Payload ID: 17036
  Gene Symbol: SYT14
  Gene Name: synaptotagmin XIV
  Uniprot ID: Q8NB59
  ENST ID: ENST00000367015
  CDS Start-End: 292-1845
gtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaattaaaaa

SEQ ID NO: 188202 - DNA, 2997 bp, Homo sapiens
  Payload ID: 17036
  Gene Symbol: SYT14
  Gene Name: synaptotagmin XIV
  Uniprot ID: Q8NB59
  ENST ID: ENST00000367019
  CDS Start-End: 92-1816
ccctctcgctggcggactcagcgcgtcctccgccagccctcgcgtctgctgcccccgccatccagttggtgcggtccatggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtga

SEQ ID NO: 188203 - DNA, 2966 bp, Homo sapiens
  Payload ID: 17036
  Gene Symbol: SYT14
  Gene Name: synaptotagmin XIV
  Uniprot ID: Q8NB59
  ENST ID: ENST00000472886
  CDS Start-End: 15-1682
atggcgagcgcatcatggcgattgaaggtggagagagaacctgtggagtacatgaacttatctgtattagaaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcag

SEQ ID NO: 188204 - DNA, 5208 bp, Homo sapiens
  Payload ID: 17036
  Gene Symbol: SYT14
  Gene Name: synaptotagmin XIV
  Uniprot ID: Q8NB59
  ENST ID: ENST00000537238
  CDS Start-End: 411-1964
ccctctcgctggcggactcagcgcgtcctccgccagccctcgcgtctgctgcccccgccatccagttggtgcggtccatggcgagcgcatcatggcgattgaaggtggagagagaacctgtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaatt

SEQ ID NO: 188205 - DNA, 3438 bp, Homo sapiens
  Payload ID: 17036
  Gene Symbol: SYT14
  Gene Name: synaptotagmin XIV
  ENST ID: ENST00000534859
  CDS Start-End: 1-1513
ctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccactttccaccccctgttgtcagatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaa

SEQ ID NO: 188206 - DNA, 11880 bp, Homo sapiens
  Payload ID: 17036
  Gene Symbol: SYT14
  Gene Name: synaptotagmin XIV
  Uniprot ID: Q8NB59
  ENST ID: ENST00000399639
  CDS Start-End: 325-1122
gcatcatggcgattgaaggtggagagagaacctgtggagtacatgaacttatctgtattagaaaagaatctggaatctgagtgcatgctgatctcccattgacttctgttctattactgtaccccatcagagagatgtgaggagttggttgaaattcaaatcgggaacatatccaaagaccacaacatcctttgacaccaacaactgtctatgcttccttagaaggagccacctgacaactgggtggttcaacaaagtggccccaggaaagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatgggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaaagagaccaagtcactgtactggtcccttgcaagtcttctagacaggttgtactgtagaactacgtaactttctgttgaaagcacttcctgtattcttgtattccaatgtaggaagctaatagagcaggactttactttcaaatttctttcagtgattgactcttcaaaattgcagtagtgtgaaaatacattttttacaaactgaaaatacagtagataagctgtcgaaaatggaaaacaattcaattttaattttctgctctgagtatttagtaaccaacactgcgtaaagcaggtagcattcaaaataagaaactgttctctctctaaatcttcactcttacttcaatttatatttgtgatatgaagactatccagttctcagtttgaattggaacatcatgttaaaaacagttatgagattccttatgaagtttctagtaacttgtaactagactttatgaaattaacagataaagttcttcaacgtgatgtcatcttgtgcctttcatgtaagttaaatttgctcatacagcttgaacgttgtatttgcaaaattaagccttcgatttttataaatgtaaagattcctcagaacagtgtcgcaagatctttatttcctctgaagtatgtaaaagttgtataatgtgctaactttttaatggcaaggcactttcatttgtttttatatttaggaactctaatcaggaatattataagctgttttctttttaattttgcttcttacctaatatatcattttatgcatatactttatcagagtatgttttatatatattaaaaatagtttcttttttctccttctcatttctagttaaaatagacaaaaacatactatttaccagttactaaaaagcagtatatcattgcttctagtcccaactaagtactatatattattgtaaactagaacttgttattaccataataacaaaacaatgcgtagatattacttcagcttggctgtactgaaaggccttaaaagaaacccaaaaagaccgtgaacttctgtatttttttagtttaaaaaatggcagctctatgcattcatacacatgaattataagaaaaaatacaaatgctatattggatgacatgaggtttgagaatgtgtgttacagggctgcattaaagggaaaaatccatcttttattgttacatcaatgagctttttccaggatttttcaaataaacaagtaagagttagaacctgaatcaaatggcaaaatatctcatttaagtgttttcagcaacagtatgaaaaaagacttgaagaggggatgtagattttactgagaaattggacttaggcatttgaagctataatgaactttttagactttgaaacaactgactgcattgctaacaactgttatcttcctaataaaaagagttatcagtcttatctgtaactgtaacagagcttagtgaaacacattagtaagaccagcttggtgctttcactcttagtgagaaaaagacctaactaattgttatttgttaaatctaccttttttcagactattcccagaattgtgtgtgtgatttgatacatccctagggatttatctggcataagtatcaaatccttcatggcttaaaaattaataaacagttttttaatatttctggaaagaccctacctccaccccagctgccaagtcctcaaagattataaattatctatatgagtgtatgtatctgtatacacacatgcaccattacacatacaacataaatatgtatatgtatattcatttgtaaaggcaaaggtgccctggctttttcagataactgaatagaaaaacatttcatacatttaggattatttttctcctctatgtatttactagatattatatttggtttgggttgctttctgctgctgttctccttcacacacagcaaaatatacatttgtttctgtagattgacacaacttataataattactcccaaaaagttgtctgttcttttagaaaaggattaaataaggctcaggggacccacttcactctactgaatctaatgtacgagacagtactactgcttctttgtgtgcttgaatttgcatgaaagcttaatagcaaaatcttctatctcagtaattatagcaaatagggacctactggtagggagcaggtgttggctcagaaacctgaaaaagacaacccactttcatacagttctattaaaatcccctaagttttctaataaaatgatatagtccaaatatggcaatcgactggcatttatgggagcctctaaacctggaattatggggtttatttttctcccaaatgagctgcaaaagataattattgctgcccagtaaacaaaatgtatgtcaaatcagtaaagaatttgtttagcataatattgccttatctttcagaagctttcttctatattcttgtgtcttcagtacaatccacttttgtttgaaatccatttgcatattatcttactgtgcatttagtgaattctcaataatgttgtatttgctgacaagaataataaattggaccacaattaaaaaaaaagaaaacccaatgagaaaataactacctgattaatatacacatgtttaaatgtaggacctggtaaagcagtttcatccaacctagcgaaaatgcccagggctgtttgttaaatcatttgcttgataccatcatcattttcatttcacttatcaagtgaatcagaagcataatcaataactgcaaagtaagatagtaccaataggagaaagaggtaaaagaattgagagtgtttgtcaatatgaagatgtgtggggatactgaatgatatcatagtctttccagtgaaagaaaaaataggctatgggaagatgtaaatttttgatggagtaagaacagtggtcaccaccaagtatttttcaagatccctctccagctatgaatagaaaggacacaaattcatttgcgtaaaattgccatttgcctacatagactagacaattcacagatttttcacaaagacagttattatatatatagttatttgagttatcactatattatttcacattgatagtttttatttctaattttgtttccattcactgtcctcagttcctctgtggcctacattgaaggtagctgtcagtattattattgtcaaccatatttaatattgaatacaagtttaagcatgctgcaaagcattttctaacgttaattttaaaacattgtctctgccctccaaagtgatggttaacagctataatttactaagatctagcacaataatttattacttgcttgattctcaaaacaatactgtgaggtaagtaatgttatcaacattttattgataaagaaactgcagcatgaagaggttaagcagactttcccaaggtcattcggtaagtaagtagtagaactgggattggaacccaggtgtaaattactctaaaacccatgctatgcatgttgcatttgcctccctgtttgaaaaaaaaactacttaggacattatatttatcaataatcccactcaccttgattgaatggcagaactaagggggaaaaaacagctggggaaagagaaaagactagaaaagaagatcagaaattttttttcttctcaggacacaagtggtggtacttttgtgtcattttgtagatgactttgatttgcaaagatttggaattgatttattctaccagtttagcctatacttatattccaaaagcatattaatcagttctgctccttgaccacttttaggaatccaaggtgttttaattgttacatgacccccttactactctatgaagggcataacctgtgtctagcccatatctcactcatatcagtggtgagacaaaagatttgtcttcctctgtcctctcattgcaatttatttatgttttattctcaattttattaagatttgtcaggaattacagctagtttattacatatgtctctcttccccctaggtaagtagtcaatgccttgttagtatctttctgtacccctttgcttatagtaggcagacagtaaatattgaattgaactaaattccctgtggaagaagccagtcacactattacatgagtcttagtttttatgaatcttgtgttatgtatggatttatttattccttcagttaatatatatttaagagtactagatatgtgccatgtgttgttgttccaagtgctacagatgcagagataataaattggtcgaagtctttgccctcatggggcctacattctaaggtaggaagatggccacagaatgggataatttcaggctagtataatgaagcattaagataggggcatgcatagagtaccgtgggatttagtagaagagtgcaacatggaattcaaaaaaatcttcctggaaaagataatccctgagttgggtcttaaagaacaaatacatgttagactcccatcaaacttgaggacacacgttctttccaagaacaaaatgtaaaataatggtttctaaactgtagtatccttaagaattattttgaaaatttaacttgggccaggcgtggtggcttacgcctgtaatcccaacactttgggaggctgaggtaggcagattacttgagctcaggagtttaagaccagcctgggcaacatagcaaaaccccatctctaccaaaaatttaaaaattagctgagcacggtggtgcatgcctgtggtcccagctactcaggaggcttaggtgggagaatcgctggagcctggcaagtcaaggctgcagtgagccaagatagcgccactgcacttcagcctgggtgacacagaagaccttgtagaaagggaggaagaaaggagggagagagagaggaagggaggaggagaagggaaggaaggaggagacgggaaagaatgaaggagaagggaaagaagggagggaaatttaacttgtattccaaaactccacctccagagattctacttcatttggcctggaagggagcccaataatctacattttattaagctctccaggaaattctgtctgagatctattgatatagaatattaagtgtattacatagtagtattcatgaaatgtttcagtgcctgtagatcagacctttaagtgtgatagtgatagtaatacagagattaagactaggattaatgttattcatctttttcttgtgcttccttaaaaaggaagatatttaatgaaaaaaattaatatttaataatgaatttctgtacattcacattcaacatacatttttcaaagtgtttcttggtataataaatatgttgattttatggcttccaaaaattcctttctatcactgttcaaatatttccttctaagttatctttacaatgatggatataaagtgaagaatggggaggtatttatcaagtaatttctttatcagtatcctaaatgaaataagactgacctttgagcaaatgtgtagtagcagccataggtgctggcatgtttgcattcttgcatacagtaagatttcttgcttccctttatcatcatctaaatggcttcattgtcatcacactcatcagatgaaatgcagtactggattcttctctaaaagcagtgattctgtgactgctgctctaaactctagttccttgattgttttgttcttaggatcctttgtttcaaatagcaagttaatacagcagcctcaggaccttctctttctctcagaataaatgctgtggataaggtacatctgagtttccatttcccctcatttcacatatagccatattttcttctctgatgtaatattttgtattaacacattttacattttgaagttttcttttcccccacaaagatatgtggttatcccacttaaaaatgagcttatttgaatatgtgaaataatgttgtcattgaattaagctgttttgtgactgctgatgtatcactgtgtttgatttggtgacagcttgaggtctggttaatataatcttaaggtaatcagcttgatagactggaattactagtttattatcaaaaaatgaatgtaaaaatattgctcttttctctccctgtttagactagtatgtgcctttttaaaaatactccctttcttcttccctgccttttttccccactcttattcatatacactcaaactagataccagagttagttcatcaaagctgaataatacctatcaaaaagtgataccctgacttttttctcttaatcacctgtactggaccatagggaggaccaaataggctttcttggggactacagaaagagcaaagcgtaatactctttaatcatagcatgtttgttgttgctgtttcggtggtggtggtggtggtggtggtggttgtgtacttaccttgaatagtgtgaagtatcctaaaattatgttgtgtgggctgggagcaggaaggaaactgattattcgtctaacaaaggtttggcataattttattgtaaaatttcaactgtttatgacatgaaaatttctaattaattataagaacaaagtcactgtggtggcaatagttgtacaagatgtttgacattatttctatgtcagtttgatagtctgtgttataaattgtcttattaggacccttcttcaccctcttctttattattctgattatcagtaaatccagtttgtactgttagacatttgagtttgtcttttaaatattgaagactattttaaaaagaaaaaccataacatctttctgtttattacattaacatgtgatctctcacctgacgatgtgtttaaaatgaattaatagataaaatataatactccgttatatactgaaaaaaattttcaaactttgtctatatattcagatattgctagcagttcatattaaatatgactattttgtttaatgagaaaataggaatttttccttatctctgagacttactgcttctctttgccattcacatctggttgaaggtggatggttttgaacctcgtaacgtcacttcactcgtcagtttctgagtgtgccaacctccttctgacggtttaattttcagtaacaatcaaaccatttattcctcaggggttggtcctcctagtgattcctgtccttaacccccattagtgttgatggaagtaatccataagcaccaataggagaaaaggcccataaaggatcagtatcccagaaccctgaaataggacggccgcttcagtacccaaatgtcattgcaattctaatggagtagaagccagcttcttggaagtgaagatttgagatcattatgtcatattctctccttttggtgtcctcccttctccctctagcttgcacattctttttattttaaattttacaggaagccttcttttaaaaacctggtttttaaaatttcacatgttgctgtaaccaggtgatttcaaaacccagaaaactgaagtacataccatacagtcataagaagtttgggggcttttttggtttttatgtttttggtgttttttttttttttttttttttttttttttgtagtgtggggagtggggaggaggaaaagggagaaatcgtgcttgttttggttttgggaagtctttttggataaatattgagaatatttatagtattctgtaattatgtgacatttgttgtgtgaggggagaccagagtagctgttgcacatacatcgactctcttaatattgaagcatatttaaacagttgtttgaagcagagctagaaattaatggtgatacttctaacagcattttgatgttataaatattactttaagtttatcaagagaaaaattccagtagtagcttgcgttataaaattaattgatttattatgtttctgtataattttattgaaattgcttttttgtggtgaatataatatagtggcaacgattttgaggaatctttaaagctgtttggaagagatggccagcctttggctagatttttactagaattttgaaataagaaagtgtataaatatgttttcagttaaattagccttgaggaagaatagttattatatgagttttaagggtcttgataaatgttgggacctactctaaaactcatgaggttcctcactgatcaatactcttgcattgtattttatttctcaaaataatgaaatttttatggaaaagctcaattagtggaatcttttattcaatattcccttactcttctttcttccttccttctttctttcctttcttccttccctccctccttccttcctagttctttcattttttcaggcaagaagcttccttaataatatagtttctacagagctttcttacttatttttctaataatggatataacagtgtgataaagtttaaatgctccgtgagcaaaactcttatcaaacaactgaagaaatacactgctgattaaccttttccttggtcttgaattgtctccagcatatttgctagtgactaaaccattaatggatcttattagtataaacacatgtctgtgtggttatcaacagtgttgtattattgtcacatttatttacatttttggtcaaaaatataaacatgcgtgtgtgaagcagtctgttttatagagtgagcatatatgtaatcgttttcatataattgaaaatgtgctgtgtgttgcattttattctcatgtcgacttttctactatgtatacaccgattgtctcggtgcctttttccttttgtataattgtattacatacagaaattgctgacctctgtgaaaacagtgtaaaaaaagttaaaattattattccgatgagattttaatggcagtttaattttccagagaataaattttgtgtgggttaaaagttatttttcttcacctttatgtaaaaaatctgtttacgttttagtactcacatggaatgggtaaacatctgacttcattgatgatgatacataaacatcagtcctaattcttgtcattgacaaataaatgttaatatgactgttacacaaaataaaataatgtcaattacataaggaaatatcaaatggatatatgtacatgttatttagatcttgggtttgaaaggaatctcatctaaatgtgctataaaatattactctcaaaaggtttgggtcatattattttctttaattgtaagtcaaatctggcttccaaagaaaatagacttacaaatgcaaacatttaaaaatattctcctttaaagttcatataaatcacaaattaaactaaatagctttaaaatgatctcagtatcttcagctggaatatgaactgttacctagtttgttctttcacttaatgtgaatttgttgtcattcatatcagtattgctatcctgtttaacaaaataattttctctttgccaatagtagtttgttgatttttaattctttttcattagctagttgtattgtttccctaagacctggagtttagatatttttcatatttcattaccttgtccattttacttccagcaacaaagatttataacaacagacttaacaagtactattttgcatatgaaaaagaatttaaacgtttggtgctctaaaactgaaagaaattaaagttgctgcatcatctaa

SEQ ID NO: 188207 - DNA, 2549 bp, Homo sapiens
  Payload ID: 17036
  Gene Symbol: SYT14
  Gene Name: synaptotagmin XIV
  Uniprot ID: Q8NB59
  ENST ID: ENST00000629778
  CDS Start-End: 1-1860
atggcgagcgcatcatggcgattgaaggtggagagagaacctgtggagtacatgaacttatctgtattagaaaagatagggtatttctctgtggccaggctggagtacagtggcaccatcttggctcactgcaacttccgcctcctgggttcaaacgattcttctgcctcagcatcccaagtaactgggactacagtatctccagaggcagttggatttttgtcagctgttggggtgtttattatcttgatgctgctcctttttctctatattaataagaagttctgttttgaaaatgttggcgggtttccagatcttggttcagaatacagtacaaggaagaattcacaagataaaatttataattcctacatggacaaagatgagcatggttcatcctctgaaagtgaagatgaagcgctgggtaaatatcatgaggccttatccagaacacacaattccagactaccactggcagattctagacaaaggaactatgcttgggaaacaaggcagaaatacagtcctctatcggcagagtatgatggatacagtagtgaagcatcaatagatgaaggaaactgcattcagagaatgagaagaacacccccgctggatgaattgcagccaccaccatatcaggatgacagtggttctccccatctgtcatgtacaccctcagaaattggggacagtaaatgtgaattttcccactgcagcaacagtccaagatgctcatataacaagtgcccaagtgaaggaagcacaggtcatgaaatagaaagttttcataataaaggatatgaagaagatgttccaagtgacagcactgcagtcctgagccctgaagatatgtcagctcaaggatcatcttcgcagcttcctaaaccttttgatcctgagccagaagctaaatatggcacactggatgtgacttttgactatgactcacaagaacagaagcttctggtaacagtgacagctgtcacagacatcccaacatataacaggacaggtggcaactcatggcaagtacaccttgttcttctacctataaagaaacagagagcaaaaaccagcatccagagaggaccatgccctgtcttcacagaaacatttaaatttaatcatgttgaatctgagatgattggaaattatgcagttcggtttagactgtatggtgtacatcgcatgaaaaaagaaaagattgtgggggaaaagattttttatttaacaaaattgaatcttcaagggaaaatgtcattgcctgtgatattggaaccttcttacaatcattctggctgtgactcccaaatgagcgtgtcagaaatgtcgtgtagtgaaagtacatcctcatgtcagtctcttgaacatggctcagttccagaaattcttattggcctgctttataatgccacaactggaagactatcagcagaagtgataaaaggcagccacttcaaaaatttggcagcaaacagaccacccaatggactgttctgttgtctaaaacacttgataggtggacaggtttatataatccgagatacatatgttaagttaactctactgaattccatgggtcaagagatgtccaaatgcaagacatccatccgcagagggcagccaaatccagtatataaggaaacttttgtctttcaagtggccctatttcagctttctgatgtgacactcatactgtctgtgtataacaaacgcagcatgaaaagaaaagagatgataggctggatttctttaggtctcaacagctctggagaagaagaactcaatcactggactgaaatgaaagagtcaaaaggacagcaagtatgtagatggcatgcgttgctagagtcatgatgaatagaataagcaagcagttaccatcaaaggcagcatatttccaattccaacattactgtttctaccaagtcccattagaagagctgttctttgaagaatcatattcaaccttctaccaaaatgctttaagttctatggaaagaacgtctcatactgacataaatgaagaaaatatgtgtatctagtagagcttgtttaggaaactgagaaacgtacactatcattgctaaactaacagtcctccagaaatttaataagatgtttttgatttgaagttaattttaatttagcaaaagagccagtcattttatgaaaaatcaaaattataagtgattttaaaaaccagaattttagttgcaatacaattttaatatcaccctacatattatttataaaacatagtttgactggccagtccctggtgtttgtaatgttctttaatatgaaaaagtagttctccaactctatcataagtcatatctaatggtgaagggtttcagtcacattgaaaattgttttatttcaggcatgttccctttgtgcacttaggttcattgtgcctcagttcctctcaaaagcactaaatctaagtgcaaacaagtattcattttcatacaggaatttttttaatatgttatttttttaaaagttcatttttcatttgcctccgctttcgcctgatccaa

SEQ ID NO: 188208 - DNA, 1369 bp, Homo sapiens
  Payload ID: 17037
  Gene Symbol: SYT15
  Gene Name: synaptotagmin XV
  Uniprot ID: Q9BQS2
  ENST ID: ENST00000374321
  CDS Start-End: 68-1333
aagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagcc

SEQ ID NO: 188209 - DNA, 6428 bp, Homo sapiens
  Payload ID: 17037
  Gene Symbol: SYT15
  Gene Name: synaptotagmin XV
  ENST ID: ENST00000374323
  CDS Start-End: 589-2013
gttctaataatcaccataataataggcgctgggtgtacagaggggacccaggcgacgctggcctccatccgataaccaccgtaacaggggctgggccgcgccgctcctccgctctaagtgctctttacatgcttcttaagttaccggcaggccagccgcccttacgagagcccctcacggacattaacccaattgagaagactgaacccagcttacgaacgttaagttgtcccaaatcgcagggctggcgagtgaggagcctgaattggaacccaggagcttctggaacccgctccagaattgcgctctcgaccggtttgtccgctgagagcgaacgggtgcgcgagcgccgcatccctgcccaaggccatcaggcaggcagcgctggggccggggacccgcgcggagactccaccccgggatccgggaaggctcccccgagccggggtcggagctgcggctggaggggcctcggcttgaggaggatctgggagggcgggggctcagtcctggccaccaggtgtgaggggtcgggtgcggagccctgtgtcagacgcggcggtgaaggctgtagccctgctctccgggatgggggtggtactctcaccccaccctgccccaagccgcagggagcccctggcgcccctggcgcccgggacccgccctggctggagccctgcggtttccgggagctcacggtcggctctgcgcccctccaccgccgggcctgggcctgggccagggacgggctggggcgggactgcggcctcggggcgctgggtccctgcccctgccgtgcactgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcgggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagccgaccatcctcgcagttgcatgtgacagccacagccacacgcatggacgtttcatccaacagctccccgagctgccagccagcccgagccaggaggacgtgagtgctgatatgcaggagagaagaggggacaaagaagccctggcccggtcagcggctctggccatacagccttccgacacactccctcctccttatctgcggggctgcctgggctcggaatcccggctcctggtcctcacagccctgatttggaccagaatctcagatgctcagaagaaagatcctgtttagtgatgacccagctctacctgctgaatggacctgcagggtaaacttgggtgcctccatctgggaaagctgatgatgtgttcatgcagtcgatgaccctcactgctttttcagccagggtttctctgccttctgcctggcagagaaaacacactgctatggggaaaatcacagggagggcgctgtgaccagcgcactcaggcaccaagtgtcggcatggctcactgtgctgggtgaaggcctccccgagcattaggtcctccacggggctgtgtcaaatgccctcccacattgtgtcaagtctgcccatggcccaccctccccacagtccaaaaccacacagccctggttctccagctgttctgctgctgtttctgtgctctccctgattaagagcattcagttcctgggctctccctttgagcaggaaatggtgaaagcatgtggctatggtatagcccacagggctgagattgctgtgttgcagtattgatgtaaaatttgttaagaaggaagtacccacagatcactgccatcaactccccagaagttgcactcaagctagtgagcagcccttgtgcttgtcacagttactgtaacaggtagtgtgtatttgcacctggcatcgtgcagcctgcacgtcaacacgttgttttgtgtaactagaacagcacatggaaccactatctctttctcttttttccttctttttcttttttttttttttattttaattttttgagacggagtttccctcttgtcacccaggctggagtgcaatggcgtgatctcggctcactgcaccctccacctcccaggttcaagcgattctcctgcctcagcctcccaagtagctgggattactggcgcccgccaccatgcctggctaattttttttatttttagtagagacggaattttaccatgttggctaggctggtctcaaattcctggcctcaggtgatccacctgcctcagcctcccaaagtgctgggattacaggcatgagtcaccgcacccagcccgaccagtatctttttcttatgcagtgaaacaactttagcaaaagaggcaatgaatgttatactgagtttctacctctttaactccacctccaatttctgtcaatctacaaacacaagtgtcgcctcgcagtgtttcgtatgaacagaatatcttgtgtttgctttttgtcacttatttcacttgcacattttttgtttgtttgtttgtttgtttgtttgttttttgagatggagtcttgctctgtcgcccaggctggagtgcggtggcgcgatctaggcttactgcaagctccgcctcccgggtttacttacaccactgtcctgcctcagcctccggagtagctgggactacagacacctgccaccacgccctgctaattttttgtattttcaagtagagacggggtttcactgtgttagccaggatggtctcgatctcctgacctcatgatctacccgcctcggcctcccaaagtgctgggattacaggcgtgagccaccacgcccggcccacttgcacattttcaaagtagtccgcaaagctgtagtttctaatagcttcatagctcacatgtaataggggttctctgtgtgtttatagagcaggctactacagtggaactgtttctgtttcatctgacatccggatagatgccagccacccccacattccaaggtgagatttctgactagcagtgacttttctagggccgcttggaaaagttgataagtatccttttctgcaggacagagtagactggtatctctgactcatccctgaaaaatctaaatggcaagagactagctggctctctgctctgatggggaggaggttgttgtttgggctgttctctacagacatagtcagggcaaaaagcatacgcatgcttcccatggaccagagaaacctggcctgggttgtctcaaatcctgtccacaaggcaactccagaagaaagaagccctttacatttccataaaacactttagaatcagctagtcaatttccacaaaataaagtgctagaatttgattggatttaattgattatgtagaacaatttgggggccatttgacatcattaaaatattcaatcttcctattcattaacatggtatatctcttcactttaagtcttttgtatgtttctcagaactatttttgtggttttcagtaaagtgttcttgcacatccttcaatagatttattcttagacgttttatatttgtttatggctagtatatacagattctgttgctacaaaactatgttgaccttgttatccagtgagaggctttgtgacattcatttaaattgtaataatttgcagattatttttgtataatcatgtcctctgtgaatgacagttttatttcttcctttcttaatctttatgccttatttagctcttgccaaactgcagtggctgagcaattggacaagataaagaaataaaagtgatccagatcataaagaaagaagtaaaactatatctgcacatgacataatcttgtctatggaaaatcctaaggaatccacacacaaaaaaactactagagctaataagtttggcaaggttgcaagatataaaattggtatacaaattgcagtggctaggacctccagcagaatgctgactataagtagtgatagtgggtattcttgtctcatcctcaatctcaggggtggtgggtgtggcatgtggagagttgtcaatattcaccatgaagtttgatggttgttataggatttttaatgtactcattaacatatattctcaagctgttaaaaagatttttttaattacaaataaggttaaatttctctcaaatacttactctgcaccttttgaaataattttatttttctcctttattctttggatgtgatgacttatactaattgactgttgaatgtcaaaccaaacttaacattcttgtaatagaaaccagcagggtgtgtacacttttgtgtgtgtgcgcaggtttatacacataaacacaacaatacttggacttatttatttaaaatttagatttattagagggagcatggccataaaataaaataaaataaaatttagatttaagtcgagctcagtggctcacatctattatccccgcactttggaaggccaaggcaggtagattgtctaagctcaggaatttgagaccaacgtggtgaaactcggtctctacaaaaaccacaaaaattagccaggtatggtgtcacatgcctgttgtcccagctacttggagggctggggcaggagtattgcgtgagcccgggaggttaaggctgaagtgagtcatgttcacgccactgcactacagcttggataacaaagcgagactctgtctccaaaaataaaataagtaaataaataaataaataaaatttagatcaatttgctgttatatttttatataaactatgtttatgacataagtataaacaaaaaaataaaataagtaaataaataaataaaatttagattaatttgctgttatatttttatataagctatgtttatgacagactttcctataatattcttatcataatgttcttgcacttgaaagaatgtgcattctgcagttgtgtgcaggtgttatgtgtatttcaactgggtcaagtttgttaatcaggttggtcaaattatctacatctttactgatatttttgtctgtttttctataaattactgagagaggataaagcctgccactgttattatgaatttgtttatttctcctttgagttttgttagtttttgttttatgcatttagaggttgtgttattaggctcatacccatttaaaattgacgttttctggtagagtgaacctttattatgtgaaatggctttctctaccactcacaatggtatttttttcactttcccccttatttttgaattttcaatgttcttataatgatgtcatgtctcttgaatagagttgttttaatcaagtctgtcaaattttgtcttttgtgtatttcgtgaatttacatttattgtaattactgatatagttgtgttcataaataccatcttactacttg

SEQ ID NO: 188210 - DNA, 753 bp, Homo sapiens
  Payload ID: 17037
  Gene Symbol: SYT15
  Gene Name: synaptotagmin XV
  ENST ID: ENST00000374328
  CDS Start-End: 1-543
gacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaagattccagttctttgatgaaagtctctattccacccatcaagtctgtgtctgataacaccaatatctgggtcattagtggctccgttttgttgtgtctgttttcccctccttcctgttttgtggtgtgtttgatcacttattgttgaatgctaaccattataataaattttagtggctccaggaaa

SEQ ID NO: 188211 - DNA, 495 bp, Homo sapiens
  Payload ID: 17037
  Gene Symbol: SYT15
  Gene Name: synaptotagmin XV
  ENST ID: ENST00000512997
  CDS Start-End: 86-495
ggcgccccgcggcgctttaagagacggcctggcagcccagccccagccgcccagaccggcgagaccagcctgcgggagcagccccatggcgggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaa

SEQ ID NO: 188212 - DNA, 1331 bp, Homo sapiens
  Payload ID: 17037
  Gene Symbol: SYT15
  Gene Name: synaptotagmin XV
  Uniprot ID: Q9BQS2
  ENST ID: ENST00000503753
  CDS Start-End: 37-1209
cccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccggaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggccgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaagctcttgccaaactgcagtggctgagcaattggacaagataaagaaataaaagtgatccagatcataaagaaagaagtaaaactatatctgcacatga

SEQ ID NO: 188213 - DNA, 2029 bp, Homo sapiens
  Payload ID: 17038
  Gene Symbol: SYT16
  Gene Name: synaptotagmin XVI
  Uniprot ID: Q17RD7
  ENST ID: ENST00000430451
  CDS Start-End: 416-1027
tgaatcttaaaagaaaaggatatttattagatgtctactgtctgtcaagtcctctactttttacaacatccctacacagaaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctaggtttgctaacctgcatttgtgtgctgtgtccaccttggttacctgtgttgctgtctactgacactaagtgtcctggcaagggtttcagggtttcaaaaacagattccactaacccctaggacattgtgagtgggagttttgggtttctcaatggtctgatttggatttaaatattgtaattttaaaaacacacatacacagtgaagtgtccgtatggaaaatattataccacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacctcttttatcttatattttgtggtttctatgagatttggttagatgaatcattttgaagcaagaaaagagttcagaaactactgttttaagacaacttgtctccttttgaatatgtaagatttcaaacttgtgactttcaaggtttttatgctgtctttctcacccaataagttcttacagaataagaaaacaaaaaacaagactactgcagtcatagatttattgattttttctgcttctggtgttcttttggattatcctttttctatgttcaattatatatactcatatatgaatattttgaatgtactgcatgtaaaccatgctctttttaaactgagtattttccatcactagagcatagtaaattgtacacagtgagtccttaataaatattgatttgattgactctt

SEQ ID NO: 188214 - DNA, 3219 bp, Homo sapiens
  Payload ID: 17038
  Gene Symbol: SYT16
  Gene Name: synaptotagmin XVI
  Uniprot ID: Q17RD7
  ENST ID: ENST00000555409
  CDS Start-End: 187-1338
tgtaactttaacaggtgtaagtatttctttcctctgtttcagctggaagttttgagagtgaaatattcacagccattaagagacctccaaattaatttctcaacatgcttattctatagttcacattcaatccagagcactgaaggaactgaacaactggacactgtagacatcagatagctggccatggtgttggccatggcgtctcaggatgttcagaacttcttccagcctttctcttcctggatatctcgggtttatgaagctctccagcaagcaggagatatgttatctgcttcgctggttaacataagcaaacaagactctaaattgagtgacaaactagatcaggacttagataatattcagattcaggaaacgtactttgaagatgaagaacaagacaatgattggagtcaagaggatgcaaattccttgtttcttgaagtggatcatttctcatgttgtaatagtgatttgcaggactctgcccaaaattcaagcccaagccttagccaacatgcaaaggactcatgttccacaatgtcccagtggcccaattgggccagtgatgaccgcaagttaccacatgtgctttcttctattgcggaggaagagcatcaccttgaaaagcaaagaagtggccttcaacatggctttgacagccagctccctggtactttagaaactgttaatggaaaaaagcaagtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagaggctaatttgaatcttaaaagaaaaggatatttattagatgtctactgtctgtcaagtcctctactttttacaacatccctacacagaaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctaggtttgctaacctgcatttgtgtgctgtgtccaccttggttacctgtgttgctgtctactgacactaagtgtcctggcaagggtttcagggtttcaaaaacagattccactaacccctaggacattgtgagtgggagttttgggtttctcaatggtctgatttggatttaaatattgtaattttaaaaacacacatacacagtgaagtgtccgtatggaaaatattataccacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacctcttttatcttatattttgtggtttctatgagatttggttagatgaatcattttgaagcaagaaaagagttcagaaactactgttttaagacaacttgtctccttttgaatatgtaagatttcaaacttgtgactttcaaggtttttatgctgtctttctcacccaataagttcttacagaataagaaaacaaaaaacaagactactgcagtcatagatttattgattttttctgcttctggtgttcttttggattatcctttttctatgttcaattatatatactcatatatgaatattttgaatgtactgcatgtaaaccatgctctttttaaactgagtattttccatcactagagcatagtaaattgtacacagtgagtccttaataaatattgatttgattgactcttcaaa

SEQ ID NO: 188215 - DNA, 13978 bp, Homo sapiens
  Payload ID: 17038
  Gene Symbol: SYT16
  Gene Name: synaptotagmin XVI
  Uniprot ID: Q17RD7
  ENST ID: ENST00000568344
  CDS Start-End: 198-2135
gggtctgaggttgtaactttaacaggtgtaagtatttctttcctctgtttcagctggaagttttgagagtgaaatattcacagccattaagagacctccaaattaatttctcaacatgcttattctatagttcacattcaatccagagcactgaaggaactgaacaactggacactgtagacatcagatagctggccatggtgttggccatggcgtctcaggatgttcagaacttcttccagcctttctcttcctggatatctcgggtttatgaagctctccagcaagcaggagatatgttatctgcttcgctggttaacataagcaaacaagactctaaattgagtgacaaactagatcaggacttagataatattcagattcaggaaacgtactttgaagatgaagaacaagacaatgattggagtcaagaggatgcaaattccttgtttcttgaagtggatcatttctcatgttgtaatagtgatttgcaggactctgcccaaaattcaagcccaagccttagccaacatgcaaaggactcatgttccacaatgtcccagtggcccaattgggccagtgatgaccgcaagttaccacatgtgctttcttctattgcggaggaagagcatcaccttgaaaagcaaagaagtggccttcaacatggctttgacagccagctccctggtactttagaaactgttaatggaaaaaagcaagtcaacagctttggggatgacgaagagctgtccacatcttctgacagtgacgaggaggtgatcaaacaatttgagatttccgtgtcccggtcccagagtttccgttcagtgacatctgagaaaggaaagcagacaggattggagcagaaaccaaaattcagccgttcgttgttgacacacggagaagatggcacagaagtatctgcctgcgaagatttggatggagccagccaacggcgttattctgagaatctctcctacggtgaagatgaccacatccctgctcactcacagtccccatgtgaaagaggggatgccaaacaccacggcacatctcaccaagagtccagtgtggtccaaagcctcaggcgccaatccacagagggcagcttggagatggagacagcttttaatagccggggatttgaagattcctatgccactgacagctcctccatgtggagtccagaggaacaggacaggaccaatttgcaggtgccatccggggtctcagagcccatctcaaagtgtggtgacctagatgtcatctttgaatatagagccgccagccagaagctcacagtgaccattgtgagggcacagggcctcccagataaggaccgaagtggtgtcaactcctggcaagttcatgtagtgctgctgcctggtaagaaacacaggggcaggacgaacatacagagagggcccaaccccgtcttcagggagaaggtcacctttgccaagctggagcccagagatgtggctgcctgtgctgtccgcttccgcctgtacgctgcccggaagatgacccgagagagaatgatgggagagaaactattctatctcagccacctgcacccagaaggggaaatgaaagtgactctggttctggagccaagaagtaatataagcagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctgatacatatggaaaactctttctcctcaattctgtgggtcaagagatgtcccgttgcaagacgtccattcggcgtggtcagcccaatcctgtctataaggagacctttgttttccaggtggccctctttcagctgtctgatgtcacgttgatgatttccgtttataacaggcgtactatgaagcgtaaagagatgattggctggattgccctgggccagaacagcagtggagaggaggaacaagatcactgggaggagatgaaggaaaccaaaggccagcagatctgcagatggcacactttgctggaatcctaggtttgctaacctgcatttgtgtgctgtgtccaccttggttacctgtgttgctgtctactgacactaagtgtcctggcaagggtttcagggtttcaaaaacagattccactaacccctaggacattgtgagtgggagttttgggtttctcaatggtctgatttggatttaaatattgtaattttaaaaacacacatacacagtgaagtgtccgtatggaaaatattataccacaattaagaccactgatgagttaatttgtgccaatagatcattgagttttagttcagggtatggggtgaagcttcttctgctgtctctgtttgcttgaagagtaacctgagattgcaagggagctgttaattgttactatttgcaaccatttaggtggatgaatcagaattttcttaatatggtacaaaaaactccaaaatatagatatgaatcagatgctgagcctcataaaagaatcaaactctaatccataaactcttatttcacatttttctctttatcaaagaaacctatttacctaacgagtaaatattataaacttgcacttttaaaataaatttgtattaattaaatacctcttttatcttatattttgtggtttctatgagatttggttagatgaatcattttgaagcaagaaaagagttcagaaactactgttttaagacaacttgtctccttttgaatatgtaagatttcaaacttgtgactttcaaggtttttatgctgtctttctcacccaataagttcttacagaataagaaaacaaaaaacaagactactgcagtcatagatttattgattttttctgcttctggtgttcttttggattatcctttttctatgttcaattatatatactcatatatgaatattttgaatgtactgcatgtaaaccatgctctttttaaactgagtattttccatcactagagcatagtaaattgtacacagtgagtccttaataaatattgatttgattgactcttcaaagtgaacatgttataacacctgtgaatggagaaatattttcagcttgtgtggaatgacattaagtttttctttgagcatttgaagtgcctataactgtcatttttttatggcatttgcagcaacatatattagtcactacttgcaatctgggcatgtgccattcagaatactgatcttgtatggttatgagcatgggattttacttatgacttaattttacatatttatgcagtgcatgtttactttccttattcataggtctgggcccttaatttcaattactttaaattggcattaataaaaaaatagggaaagaatgtatgtacatttaatccctgcgctcaatgtgcagctcttctgagcaattgctcagtcacctatttttagtttctatgtttcattgtggactttttcctgtctgtgggaagagtgatagctagtgatggctgtatacagttaaaaacacataactcctcctcagctccacgttttgacagattgtaagcgtaggctgtaacacttgaagaacatatttattccttacagtgtgtaatggttatcctgacaagaccagactagggcacaggataactctactatgctttcagggttcagtctttgaatgaaatgatttcatatggaagaatgagaatttgccaaataaattaataccttaattacttttcaggtcatgggagtttcatatatatggctgctcagttattaggaatatgtaataaaaccatgttcctctgggtttttaccctacctttctttgggagatctcagagtgcttttccagcattatatccattaactgctgagtggtctttgcagcgtggctaagtcattgagtagaactgagtgcgattgattaagtagcagcacaaagaagtggcttttcacatctcttactctttatgccttgtgtttaaagggaagtagaacagcctcgctatgctttcctttatgcagtaacataatagcagcattcattttaaaatttacatttgaaaaaaatctgtatatattgtacagacagccctgaatttttccctctcatattttcctgctgctgcatccttgtttcttggtacccaataatcacctatacttcattttctgttcccaagacccacccatttttaaggttttcggctggtgtagtgaagatatttgtgtgcttgatctgccttccaatggtctgtttatgatacagtttacaggaatgcgcaccattttaagggaaggaatgcctgaaaacattttttatttttataattttactatgttggtgctactcaccaaataggatgcatgtacatcttgaatatacagcaacattcaccctcagctgattgtatacatttaagtgctgaagacaagatatataacaatatgtggctgattttttttacctttatttgaaattctagtttagtaagatcttttgattttgtgcacttaaactcccttattttcttggcaaagtctagacacaaatgcatttaacatgtttttcacttgagcttttacatttggttttcaaaagagttatgaaagataattagttggttctgcagtaaaaaactgcttttgcctatttcttccagctaatgattaatatctcatagggagatttgacattgaagcagcactggtttttgttgcttgagtaggtctttcagcgattttgcctgaagagcatgcttttaaaataatatcgttaagagtaaatgatgcgctgggtttatggaaatctgctttatagtgtgccttcttttagggtgtgagtttacactgaattgagaaatcctgatttcaccaattacggtggtggctgttgtactctctactcccctctgactattgttgaatttttaaatggaccattcaccaggcagccgaacacctgctctccgttccctctccttcactggctcccagtgtgatgcacagttgttttggactctgtttttgctgatgctgcataactgttggaggtgggggtgtcttgccttccctaacataagaagaatttgtaatgtctttggatgtggcattccacctgcatgaaatcaggaaaagaatcatcaccatgtttgtgagagggaaaagagtatggcattgcatagtcattcgctttaggcactattaattctgacatccttcattgaaaattaactgacatcaaatgtcaatattctccatagtcctaggtgccagtgagcctgaaacacagcttctgccttttcaatgtgtagatttcatgatattttacaaattattgttacctcttgtgcagttactgtgctttagatgaccttatctgagaaccaaaattcttttctttccagatgaagtactatttaagtagaaactagcattaggttaaatcaaagtgcttctctgatagccaccaatttgatttaattgatgattcggtgtggacaccactgtgggtttccaaaaaaactggttatccttttgcagcagaggacttagtattttaaaaacagaaaagtaagtaggaaagtattatttgtaaatgtcataaaaccagatggaggcatattctttactgataaagaaacaggactagaacacgcatgtggtatctccttttacttttgaggaaactgtggttaaagaacattctattctatttgatctaagagcaaagcaaatgatggataatcctgaaatggtaaaagtatttttgtcttaaaaattattcatttgggcaaagtcatttacaacaaaataaaaagtcatacagcacacctatggaagaattaaagaatacataaatgtgctggatacatttagcatcctccagtgagttgtatgtaaggagagtaaactaataaaccaaaatacatatcagatcaactagctatcacttttctaaaacttgtagaattctgaaaaatatttaaagatgggagaaacgaaactgtgctaagacaatgagattggcatagcacagtgaagttggcacaaactgtgatcctggcctgggtttacatgaaactctgctgtgtggccttaagaaaattacttagccagcctgtatcctggtttcttcaactggaaaatggaaataatacctacctcattaggtgtcttaaaagatatcagtgaaatcacagatgtaatgtgcctagcatagagccgggcatgtagttagcattccgtagttcctccttacagtcatgcctgaaaaagaaaatatttaagatgtgtcttctttttctagcaaatgttattataacactagagaaaaacaaaaaccaacgttcagatactgtaacaaggataggctcatgaagccaggctggattcgtaaataaaggaggcttcatcaggacagcctaatcagagataagcctggtatgtggaggaaattgagccttaatagagtccaactgtggtagaaccaagtctttgcatttatccccttagtttggagggagtacaaatccttgatggtttgtgtgtacctcttgatcgatcacaaacaaggcctctccttgtctccagttctcttattcataaatggacaaggcatcttgtcgcctttatcaaaagagttggtgacaatggcagtttgactacatatttcaactgtgatccaaaaaagtaaaataaatgatgtgatactatactgagactgttttaaaaatggataacactttctttaaaacctgcattatatatccattttatatcctgatagccaaacattttaaaatactctaataacacagctctcaaaacgtatctgtttgactggaatgtcctgctcagaacaaattatcactgtttcccttatgagatcctaatgaaagaaattcagttgatactactttttaaaatgggttttaagagtggcttgttgatataatagcgcatccacttgttctcaagtgattcaaaccttgagtaaaaaggagagtttctggagaatttagaagaatctttgttgacatttaatctagagaagtcttcaggagcaaaccacttcaagttcagtgtaaccaggtgccatgagtcagtcatgtgctacttgtggttttaaacgaaacatgattctgggatgagaagtgcgaggctacactcctaatataatcaaattgccaaagcactgttttgagtcctcggtatcccaattaaggagaaacatgaagacattggagaatcacttagcttagggcttttagtagggaataattaaacatgtagggaaggtgaaggagttagatgggaggtaagaaggctgaggagatttctagtaacaatgatccaaaagttctaaccagggggatggtgcacactttctcttcttgaccacatggatagatttcagagcatccctctaaatcaagtctggagaattatgtgaaggttgtttctcattaattcaaaatgtattcattgtctagtactatgctatctgggctggcacagaacttaaaatctctttggagtgctatgagtgcacattgaagcagttggtcatcattatacaatgatgcttaccaatatacaactgttaagttagtctaactatgtgccataaacagtagagttccttgttactagtattggaaggtgaaacattggctgaatttattggggcaagtgtctaggaagccttggactggcagtgagtcttggttgcattatatgggaaattggtggggatgggggtgtcatagaatcatcatctttggaagttttttaaaatagaaaaatgtacttgaagtcttggttctgctaaagaagaatgagaggacacccatgaatataccctttataaagttccttctaatatttaggtgtaacgttaaaaaagaatcaacaataacactccaggcctgtcttcttccactttggacattttttccacattgatttttctctgcatcatagaaagttttctctgaagagttcctatttgggttttgtttagggctttggggatgcctgcaggctcagggggagtttcctctcctatggtgctttgactgtttttgtttcccttgggtcacaaaaccatatcctagacacacagacaataatcaccttatttatatccactgtggaacctgtgaaacagctcgaggctttacagaacaagctcataggcagtcatggagatctgaggcctttcttggaatgaagccgctaacttgctaactgctttccattgctcactaatgctgccttaaggtttcttcatgggaatttttacttcatgcctttgagtgacagtgttaccagttttaccttgaggatgatgagaaggctgacttcctattgtattgccatatttatgcattatttttgtttacgtcatttcccccttgaagtatctagttgctggggttttgtttgttttatacaaaatttattcattcaaaaagatctttataggttgggcatggtggctcacacctgtaatcccagaactttgggaggccgaggtgggagaacagcttgcgtccaggatttctagtccagcctgggcaacatagtgagatcttgtctctacaaaataccaaacattcgctgggtatggtggtgtgcgcctatagtcccagctcctcaggaagctgaggtgggaggattgcttgaacctgtgaggtcaaggctgcagtgagccgggatcatgccactgcattcagcctgggtagcagagtgagactctgtctcaaaaaaaccaaaaaacaagacctttttaagtgtaaatgttccagactcagggttaggggttggagaatggcagatggataaaatagtttaagttcaacaatatttttttgttgtttctaaatattctttttaaaaactagagtctgataagaaatctaggtaaataataagatcttttattaaccttgaatttttggcttaatgtatttctgtaattgtctctttccccctttgaaaggcagaagatttagggaaggtgaaagttattaccctgtatctaattaagaaataggtacacttgtttgtcagtctatgctttcattcaaaataaatggatatgttttgtatctgggggaggaaatgcatcattccattccagcagtgaaaagaattatagcatcaaataggatatttagtattcttgacttttataattaaatactgaatgccctttgcaagacagtaagttagatcctggaatgctaggtctgtacaaacttgacacatttcttacaagctctgtgttttaatagtcaaaggcattgctaccctttgctttttgaaagagtgaactggtaacagtagccgccagagaaagaggtgacaatctaaacaaagagccctgcttacctttctgtgactaaaactagtcttaaaaactgaatacatttggggcatccttatgaaataggtaaaggtcaacattgggagtgtccctaccttggcagatagaccaatacttttttcctagactcaacccatttttaaagcaggagtttttccaatggatttattgtttataattctactaaacatgtcttagtccacgcaaattaactcaaaatctttggtggcctgaaaattctgactgaaagcaagtttttcgtgttgcccagttgatagtccataataaaaaatgtacatatcttgtttaaaaaagaccttgatgtttgagaagaaatatcggaagtctgccagtaaaaactctgattaagtgaggaacatgtacattaaaagatattttcatgtaagttattttaagatagttgcattctaggaccatgtttcttttttgagagtgtttctttgtcaagttccttatagccaatgccttgaccaaagcttactaattttgccacatttccttgtgggttatgataatctttattaattcacaactctaccaaattataatacagtcttttattatgccaccatatgaatgcagctgcaaattcaattttgtgaaatacaaagtcctttccagaattttaaaacttaatttcagtatagattttaagtttgtgaataagaaattagtatttgtataccttattatgacagaggtttctgttacaatattttctcttatagtgttgggataggatttgacctgtattttcaggttaaagctggtctttgagatctactttttaagaaattaataaattttattttttagagttttaggttcacagcaaaattgatcctaaaatatagagttctcatatactccaaacacaaccttcttccccgtgaacattttgaacaccacagtgctatatttgttacaactgatgaaccttcattgacataacattatcacccaaagtgcatagttcatattaaggttcactcttggtgttgtgtattttatgggttttgaccaatgcacaatgacgtgtgtccactattgtagtatcatacagaagattttcactgccctaaaaatcctctgtgctctgcctattcattcctccctcccacctaagccctggcatccactggtccttgtactgtccccagagttttgccttttccagaatgtcatacagtatgtagccttttcagattggcttttttttttttcacttagggatagtcatgtaagttttcatgtctttttatggcttgatagttcatttattttaagtgctgaataatatttcattgtctggttgtatcaccatttatgacctatttgctcttatttctagttccagttgctatggcaaattttattaaagtgcgtgctctcaggaaaagctgcatatattttatatgatccatcaaataaaatgtagcaacttccagtctagaataaatttcacctatatgatattgagcttgttttacattgggggaggagatttatgaaaaaatataataatttcataatttatattaccctatctatgagtttttccctccattggaatctaaacagaaagttctgaaggttatgaagacgtgatcccaaatttagtgactctgtagtgtcttttgttgagcaatgagttaaatacctgtcgataaaaagtgttaattatgttattactgattcatgatagaaaatcaccttctgtcgctagtttatatgactttacatttaccactcctgccaagagaaaggaagctttgtgattgtgccccgtcatagttaattgtacaaatcaattaaaaatggtatgtaagcatctggctcacacagcagctctgaattctgaatgaaaagataacccatgctaatgtatatgttgcatgaacaagtagatgggtgttggaaagaaaacactgatagtcactctgggtgaagggggaggcctggccaatgatttgtatctgagaaacattttgagattatttatatgtcttctgactgccctttgctttgtagctacagcaacttgcagaacctggcattattgcagagatgaaggtatagttgtataaagaatattggattaaagttgatgaggcctgtgttctgatatcaaatcttccactaatgagctctaaaatgaatatcaagtcacaattttttcaagccttcattgttgcatctatcagatgggaatagtaatactcattttacctatttttaccaggtggttgtaggaacaggattcattcattccttcattaatataatgaacactttgagaccccactatataacagggccatacatatgacaaggtgatagatggaaagacgttttgcagaatttttgaagacttgcaatgtttttgaagactacaggatagtttgtgatttttatattaaggtcgtatcaactctttatgtcaatatatcaaagtaattgacacttttagagctctgccaatcagtgggccatattcatagaatgtcagtaatctgtctgaatacaagttatagttggtctttagctgttctgtctctgaggagctagaaataaaatattaggttctaatttttttttgttcaaacactgatcatgtaacaaactgcaaatccatgttttcagcaggttcgccaacctttgagttgaatgcagacctttctttagaacaacctaactttgagtacaggcaaagtattaaatggaatagcttttcctcccctacaaagtggatttgaatacagtccttagaaaaattcttcccctgccaaaaaaggtccttcaatctcctttattatttttcttttgaagaatcaaacttgtccatctctcccctcccaagtgactttcctcactcatgtaatcattttcttcataaatgcccttttactatcccacagaaaaagtaaagatttaaaaaatcatttttaaggtacatccaagatttcatagcaatattttatttgtgttcacagtgcaagataaatctgactttctcaatatttttggtcttcatatggcatctgaaacagttgttcacattcacacatttatgtttcaccatatgcatactgtgtacagctctgttgttctaaaatattttattggttttcctttatatctcaacttttgatgggtgtccttgaagaactttcatgaaaaaaatgtaaatgtgaatgattcattcattttgaacatatgtaactattttaggagattttcaggagattttaccctacatggagtacactgttcttagcagggaatgtgctttatattactattctactcacagctggatgctgcagatgtattaacattgtaaacatgtactttttctattctatgcttactttaatacattatttatatgtgctagactgtgctgagttttggtggttgtcaaaggcagtcagtaattttataaatttcacttttgtggatagttaagtataacatggtttagtataaaatctggtcttcctctagatttctaagtcactagaagaatttcttggcaaattgattgttcaaggccagttttgttagttgtaaggtggaagccaccccaatcctctcccagtgtttcataggcattttcagacctggatgctattatagttcctcctctagttttccagtagagaattcgtatgtggtccagaggttcaagagagagagagaaaaaatttctcctcaaaagaattgaacccttactttagaaacttctgacaatcttcagaacattccatgtgggtgtccttgtgtttctcatagtatgacttattgattcatggtgtctcttattaaagaagcatgaatgtatcactagctgttaccagaacaaacagctgtagaatgtaatgacccatcctatttctaaatttacttctatcagtggataatttgtgtataggaaaaggtgtggaaattttttaattgttaaaaactggaatacctttctaccttttgtagtctttaagatttcataatgatggttttaatgtattactatcttactattatgtattgtgtttaaacaagaccaatcagtgaaatattgaatgtcaatactttttgttagaaatgccctctgaaaatgttagaaaatgtaaaactttacctgtgacaaggaataaattcatgattagaagaattatactgtttttcttgtgcaaataatacttaaggcagatgttcagtctcacagtgatgttggaaagcatattttatgcagtctaaacactatttctgtattagatatttaaatgcatgaggataaattctaattgctttttgtttaaaacagaaacatagaagaagcattagccccagtttgtataaaatgtctgctgcaactgaattcatgatagttcatgaaaactgaaaatcattccaattttgtaaaactgctgctactggttttatcaataaagttttagcagatggcttata

SEQ ID NO: 188216 - DNA, 3081 bp, Homo sapiens
  Payload ID: 17039
  Gene Symbol: SYT17
  Gene Name: synaptotagmin XVII
  Uniprot ID: Q9BSW7
  ENST ID: ENST00000355377
  CDS Start-End: 399-1823
ccccggcgtctccggccccgcctgcgctggggtcgctgcagtccccgcagctgccccgggctgcttgcccaggcgccccggccttattccagcctggggagcgcctcggtggggagcacgggacagcgagggaggccgaggcgggggccctgggcgcccgatatctccgaaccggggaggcggccccgattccgagagccggaacgcagggaaaggcaaggacggggcggccggcggaggggcgggcgccgctcatcagccacgccagtcacgtctggggccaccggctgcctttttcttcctttccccctttgctttcttccccctccgctgttggcgagggcaaagtggccgtggcggcgccatgcccgggccggagtgagtgcgcgcgggcgaaaatggcgtacatccagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggcgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgccatgca

SEQ ID NO: 188217 - DNA, 551 bp, Homo sapiens
  Payload ID: 17039
  Gene Symbol: SYT17
  Gene Name: synaptotagmin XVII
  ENST ID: ENST00000566261
  CDS Start-End: 272-551
agtttttccaacccagtttggggagagggctggatgggaaggaccctccctgctgcagacttcatggcaggctgcactgtgtcccctcggctccacggctgccccgggggcgctgctttcgggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttca

SEQ ID NO: 188218 - DNA, 1702 bp, Homo sapiens
  Payload ID: 17039
  Gene Symbol: SYT17
  Gene Name: synaptotagmin XVII
  ENST ID: ENST00000562711
  CDS Start-End: 259-1671
gttagctaatcatgtccttttgggttggctacatggctatttctgtataggaaggtttgctcttctcctgaagtgtggctgcattggatagcatgactatctatccgcccgctctgattcataacagcatacggtgcaaatcaaatcgaaatgctaaagtttcccatttatttggtgttggttaaccaggaggctaccagcagccctgaaaatagcaacaccttgttaggatgttaggaagtcagctcccttcccaggatgttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgttt

SEQ ID NO: 188219 - DNA, 1721 bp, Homo sapiens
  Payload ID: 17039
  Gene Symbol: SYT17
  Gene Name: synaptotagmin XVII
  ENST ID: ENST00000568115
  CDS Start-End: 539-1717
ccggccccgcctgcgctggggtcgctgcagtccccgcagctgccccgggctgcttgcccaggcgccccggccttattccagcctggggagcgcctcggtggggagcacgggacagcgagggaggccgaggcgggggccctgggcgcccgatatctccgaaccggggaggcggccccgattccgagagccggaacgcagggaaaggcaaggacggggcggccggcggaggggcgggcgccgctcatcagccacgccagtcacgtctggggccaccggctgcctttttcttcctttccccctttgctttcttccccctccgctgttggcgagggcaaagtggccgtggcggcgccatgcccgggccggagtgagtgcgcgcgggcgaaaatggcgtacatccagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacaggatccaacagccccataccagcctgcgaactgagtagtcacccagctcatggtatcagtccttggataccctcacctggaaatgaacatttccatggcataaagaagcaagtaaaggcaataaaagtagaatgattga

SEQ ID NO: 188220 - DNA, 5092 bp, Homo sapiens
  Payload ID: 17039
  Gene Symbol: SYT17
  Gene Name: synaptotagmin XVII
  ENST ID: ENST00000562034
  CDS Start-End: 3799-5040
ggggctattgagtagtcgcccaacaaacacttgggcgaccgcctactaagtgctggcactggggatacagtgatgaaaacagcacagttcctgcccctctgggtgcgcaatttagtgagaaatgaacatgattaccggctcctggagttcttaatggccgccttcagcacagagaaattaagtgacttgcccaaggccacatagctgcttaggggtcaaggtgggatctcaagaggggactgtggtagatatgttaagcatctcatatggcgatgacccagtgatgttggttttccttctagaacaaggtgttaaactttgttgtcctgtaaagtgccagatactattttttttctcttggaggctcacatggtctctgtcacaactattccactctgactatagcaccaaaactgctatggacagtagtaaatgagtgggcgtggctgtgttccaataaaactttatttgcaggcaccaaaatttgaattttgtatactttgcacgagtcaagaggcattcatcttttttttttttcaaccttttaaaaactcacaaattattcttagctcaagggctgtagcaaaacaggctgcggggctggttttgatctgcgagccttagtttgccaacctctgtttagaatgcatgggttgtctttcttcctctttctttctggtgtgaattggttctcttccatcggtgtcaaacacgtgagcccaggagacccaatgccagaaagactcagcatgcctgggaatgtcagggcaccctctttcatcttctttgctttctctctgctccttgacactcatcttgcacctgggctttgagaaagttggggaggctgtttttcagcagggccatgaggtgaccttgtctctgttcactttggtttcataaatggcctcttttgaccaccacatgtctaggaaatgcttccctgtattcagaaaatggtcatagattattatgaaaaagtatcactttatcctaacattctaaagcactttttcatgcaagccctatgagggtataatattttgctgttttgtgccctgctgtacctgccgggacaatacccagtgcctactgggttccactaggtcttgacaatcacctaattctcatcacagaaagggtgcattttatttttcagctggaccgcacgcaagtatttgcatagtcagtgtcctgtcccacctcaacagcacgcctttgaggtatagagtagcctttccactaaagaagaggtaaccgaggctcagagaggccccctgtcttgcccaagtcacatgatcagtcgatggtgagactaggactctagtacttcctggctcagcttgttgcgtggcccctcagcacctttgggtcttgttctgtgtatggtttgagttttggctttagagagtttgtgataagtgcctttgactatttcccaagctgttgctattcccttaccacttcgaggatttcaattttttcacaagccacgtaccacctatactatgatgatgatgatgatgatgatgatgatgatgatgattatgattattattttagacagggtctcactctgtcgcccaggctggagtgcagtggtgcgatctcggctcactgcaacctctgcttcccaggttcaagtgattctcctgcctcagcctccccagcagctgggattacaggcgcctgccaccacgcctggctaattttttgtatttttagaaaagagggggtttcaccatgttggccaggctggtctcaaactcctgacctcaggtgatccacccgccttggcctcccaaagtactgtgattataggcatcagccaccacgcccagccctacctatgctattattaacttaattttttttctataaatgggctcatttttatttttactttaaaaaaatcatatgaaaaggaaacattatgtcactaatatcataggaaaccaagatcatgtgacatcgcagaaggcaactagaagaataaacccaatgggaataatgccacattactgaattctaggtggacgtggctgtctccaagcctctggacaagatctactttctttgtttaaaagaaaggggatgggggagggtggaaattggtaagtggtaaaagatgttaacatgtagtggtaccaaattgagactttctcctccttaaaggagaatcggaaaaaagataataactttctccctcttgattcaaagttctgagtttgagtcccacctcagttcacctctgggacatgcccgaggttgggatgcagtacttctaacctatctagcctacttggcccatttggaaaaccaccttaaagagaaggagggagtctgtgccttgagaacccaggagacgaagatggggaggcggggtggggccacaacaggaagggaggacctccttcctcaagaggaccagattagggcttcctttttagttccctctatttgtgggtggtgataggaaacaccccaccatcaccattggagcagaattggaaggtagggcctccgggagggcgggggagccaagtaacatccactgtgtgcctgcctgcatgttagctaatcatgtccttttgggttggctacatggctatttctgtataggaaggtttgctcttctcctgaagtgtggctgcattggatagcatgactatctatccgcccgctctgattcataacagcatacggtgcaaatcaaatcgaaatgctaaagtttcccatttatttggtgttggttaaccaggaggctaccagcagccctgaaaatagcaacaccttgttaggatgttaggaagtcagctcccttcccaggatggtaagtggaaatatgcagggcttttttttttttttgtaaaatttttttgagttgctggaatattgctaaactggtcttgtctctctttctttaaccccttcgttcccttacgcccttggcttcatcgtggatcttaaaagggcagttggaaccattaaacgaggtgggttcatttgatgatttgtttggtctggtttctaatcaagaaatgcctgactttcattttggagtcttatgtggggctgtggggatattgaatattcaacaataacctggtgttaataacggcacagtttccattcctttctaccgaaaggagatcccggttttgaaaagacaccagttgacaagacaagtttccctctccacccctacttattccgtttgattatctctgtctgtttcatgtcaccgagattttttaaaaatattttttcccctgctttcaagaagacacagtaatattcattgtgtttcgaacatatcgtatagcccttatgatgttgtataaaccacccacatgtcaagaaagacgttcacataaactacaaaagaaaatacctgcaaatgttttgcttgctactaacggctccagcgagttgatgtttgctatctttgtgcctgcagttggtaaatagaaatggaaaacattttgttctaagtgctgagcagcagagccagaactcctgaatgtctatttctcatccgagatcggctgcttgtaattttgggtgttgtttctcctcttcctcttccccaccctgcccacctcccctctcccccatccccccgcccacctcccccaatggcctcagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaagacgg

SEQ ID NO: 188221 - DNA, 580 bp, Homo sapiens
  Payload ID: 17039
  Gene Symbol: SYT17
  Gene Name: synaptotagmin XVII
  ENST ID: ENST00000570264
  CDS Start-End: 343-580
ctctgcaagcctcaccgcaaccgtgctaggcgcgtcgggtggggcgggaataaagtttttccaacccagtttggggagagggctggatgggaaggaccctccctgctgcagacttcatggcaggctgcactgtgtcccctcggctccacggctgccccgggggcgctgctttcgttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaac

SEQ ID NO: 188222 - DNA, 531 bp, Homo sapiens
  Payload ID: 17039
  Gene Symbol: SYT17
  Gene Name: synaptotagmin XVII
  ENST ID: ENST00000565183
  CDS Start-End: 1-427
gccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagctggtgcatggactcaaacttgtgaaaaccaagaagacgtccttcttaaggggcacaattgatcctttctacaatgaatccttcagcttcaaagttccccaagaagaactggaaaatgccagcctagtgtttacaggatccaacagccccataccagcctgcgaac

SEQ ID NO: 188223 - DNA, 812 bp, Homo sapiens
  Payload ID: 17039
  Gene Symbol: SYT17
  Gene Name: synaptotagmin XVII
  ENST ID: ENST00000568433
  CDS Start-End: 264-770
atcgggctcttacaagaaaggaaatgaggcctgtttatttgtgacatcgcttccacaagggacgaggtagaagtgggcctgtcacccagttccttctcctgtcttggcttcgattctgtgggggttggataggacagggggtggaacatcgtgctgacaacccctctcggcccgtggtgtggcagcagctcagcctctgtgttgggggctgcactgcttgatcttggatttgtttctggtgctgtgaatatagtagtggacacatgggcactttctttgcctttatggagaaaaagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaa

SEQ ID NO: 188224 - DNA, 1370 bp, Homo sapiens
  Payload ID: 17040
  Gene Symbol:
  Gene Name: Synaptotagmin-15
  ENST ID: ENST00000615923
  CDS Start-End: 1-1333
aagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccagaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggctgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagccg

SEQ ID NO: 188225 - DNA, 1362 bp, Homo sapiens
  Payload ID: 17040
  Gene Symbol:
  Gene Name: Synaptotagmin-15
  ENST ID: ENST00000622861
  CDS Start-End: 154-1326
actgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcggagcagctggccctggtgattgggggcaccatcggggggctgctgctgctgctgttgatcggggcaagctgctgtctgtggagaaggttctgtgccaccctcacctatgaggagctgcctgggacaccagccatggccaccacagctgcctccagtgggcagcgggacaggccctgccagccgcatgctaggacccaactgagcaggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccagaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggctgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagcaggctactacagtggaactgtttctgtttcatctgacatccggatagatgccagccacccccacattccaaggtgagatttct

SEQ ID NO: 188226 - DNA, 5321 bp, Homo sapiens
  Payload ID: 17040
  Gene Symbol:
  Gene Name: Synaptotagmin-15
  ENST ID: ENST00000623662
  CDS Start-End: 589-2013
gttctaataatcaccataataataggcgctgggtgtacagaggggacccaggcgacgctggcctccatccgataaccaccgtaacaggggctgggccgcgccgctcctccgctctaagtgttctttacatgcttcttaagttaccggcaggccagccgcccttacgagagcccctcacggacattaacccaattgagaagactgaacccagcatacgaacgttaagttgtcccaaatcgcagggctggcgagtgaggagcctgaattggaacccaggagcttctggaacccgctccagaattgcgctctcgaccggtttgtccgctgagagcgaacgggtgcgcgagcgccgcatccctgcccaaggccatcaggcaggcagcgctggggcccgggacccgcgcggagactccaccccgggatccgggaaggctcccccgagccggggtcggagctgcggctggaggggcctcggcttgaggaggatctgggagggcgggggctcagtcctggccaccaggtgtgaggggtcgggtgcggagccctgtgtcagacgcggcggtgaaggctgtagccctgctctccgggatgggggtggtactctcaccgcaccctgccccaagccgcagggagcccctggcgcccctggcgcccgggacccgccctggctggagccctgcggtttccgggagctcacggtcggctctgcgcccctccaccgccgggcctgggcctgggccagggactggctggggcgggactgcggcctcggggcgctgggtccctgcccctgccgtgcactgcgcggctccccgcgccgcagctgggcaccagcagcaccacggaccgcccctgtgctcgcccgacggcgccccgcggcgctttaagagacggcctggcagcccagccccagccgcccagaccggcgagaccagcctgcgggagcagccccatggcgggccaccagctgtgccattcgtggtgcccccaacccttcaaggccgagattgggtgcccctgcacagtggagagtgggccgatgccccatgggacccctgcccggcatcagagctgctgcctcacacctccagcggcggccttggagatgcatgtatggtgggggccatcaacccagagctgtacaagttcccagaggacaaaagtgagaccgacttccccgacggctgcctggggcggctgtggttctcggtggaatatgagcaggaggctgagcggctgctggtgggcttgatcaaggcacagcacctgcaagccccctcggagacctgcagccccctggtgaagctctacctgctgcccgatgagcggcgcttcctccaatccaagaccaaacgcaaaacctccaacccgcagtttgacgagcacttcatctttcaggtgtccagcaagaccatcacccagagggtgctgaagttctccgtctaccacgtggacaggcagaggaagcaccagctcctgggccaggtgctcttccccttgaagaatgagaccctagtgggggactgccggcgtgtcatctggagagacctggaggctgagagcctggagcccccctcggagtttggcgacctccagttctgcctcagctacaacgactacctgagccgcctgacggtggttgtgctgcgtgccaagggcctccggctccaggaggacagaggcattgtcagtgtgtttgtcaaagtgtctctgatgaaccacaacaagtttgtcaagtgcaagaagacttcagctgtgctgggctccatcaaccctgtgtacaatgagaccttcagcttcaaggccgatgccaccgagctggataccgctagcctcagcctgactgtggtgcagaacatggaaggggacaagagccagcagctgggccgagtggtggtgggcccctacatgtacacccgcggcagagagctggagcactgggacgagatgctcagcaagcccaaggagctggtgaagcgctggcatgcgctctgccgcaccacggagccctgacccttcgcccagcaccgcggttccgctttgggagccgaccatcctcgcagttgcatgtgacagccacagccacacgcatggacgtttcatccaacagctccccgagctgccagccagcccgagccaggaggacgtgagtgctgatatgcaggagagaagaggggacaaagaagccctggcccggtcagcggctctggccatacagccttccgacacactccctcctccttatctgcggggctgcctgggctcggaatcccggctcctggtcctcacagccctgatttggaccagaatctcagatgctcagaagaaagatcctgtttagtgatgacccagctctacctgctgaatggacctgcagggtaaacttgggtgcctccatctgggaaagctgatgatgtgttcatgcagtcgatgaccctcactgctttttcagccagggtttctctgccttctgcctggcagagaaaacacactgctatggggaaaatcacagggagggcgctgtgaccagcgcactcaggcaccaagtgtcggcatggctcactgtgctgggtgaaggcctccccgagcattaggtcctccacggggctgtgtcaaatgccctcccacattgtatcaagtctgcccatggcccaccctccccacagtccaaaaccacacagccctggttctccagctgttctgctgctgtttctgtgctctccctgattaagagcattcagttcctgggctctccctttgagcaggaaatggtgaaagcatgtggctatggtatagcccacagggctgagattgctgtgttgcagtattgatgtaaaatttgttaagaaggaagtacccacagatcactgccatcaactccccagaagttgcactcaagctagtgagcagcccttgtgcttgtcacagttactgtaacaggtagtgtgtatttgcacctggcatcgtgcagcctgcacgtcaacacgttgttttgtgtaactagaacagcacatggaaccactatctctttctcttttttccttctttttcttttttttttttattttaattttttgagacagagtttccctcttgtcacccaggctggagtgcaatggcgtgatctcggctcactgcaccctccacctcccaggttcaagcgattctcctgcctcagcctcccaagtagctgggattactggcgcccgccaccatgcctggctaattttttttatttttagtagagacggaattttaccatgttggctaggctggtctcaaattcctggcctcaggtgatccacctgcctcagcctcccaaagtgctgggattacaggcatgagtcaccgcacccagcccgaccagtatctttttcttatgcagtgaaacaactttagcaaaagaggcaatgaatgttatactgagtttctacctctttaactccacctccaatttctgtcaatctacaaacacaagtgtcgcctcgcagtgtttcgtatgaacagaatatcttgtgtttgctttttgtcacttatttcacttgcacattttttgtttgtttgtttgtttgtttgtttgttttttgagatggagtcttgctctgtcgcccaggctggagtgcggtggcgcgatctaggcttactgcaagctccgcctcccgggtttacttacaccactgtcctgcctcagcctccggagtagctgggactacagacacctgccaccacgccctgctaattttttgtattttcaagtagagacggggtttcactgtgttagccaggatggtctcgatctcctgacctcatgatctacccgcctcggcctcccaaagtgctgggattacaggcgtgagccaccacgcccggcccacttgcacattttcaaagtagtccgcaaagctgtagtttctaatagcttcatagctcacatgtaataggggttctctgtgtgtttatagagcaggctactacagtggaactgtttctgtttcatctgacatccggatagatgccagccacccccacattccaaggtgagatttctgactagcagtgacttttctagggccgcttggaaaagttgataagtatccttttctgcaggacagagtagactggtatctctgactcatccctgaaaaatctaaatggcaagagactagctggctctctgctctgatggggaggaggttgttgtttgggctgttctctacagacatagtcagggcaaaaagcatacgcatgcttcccatggaccagagaaacctggcctgggttgtctcaaatcctgtccacaaggcaactccagaagaaagaagccctttacatttccataaaacactttagaatcagctagtcaatttccacaaaataaagtgctagaatttgattggatttaattgattatgtagaacaatttgggggccatttgacatcattaaaatattcaatcttcctattcattaacatggtatatctcttcactttaagtcttttgtatgtttctcagaactatttttgtggttttcagtaaagtgttcttgcacatccttcaatagatttattcttagacgttttatatttgtttatggctagtatatacagattctgttgctacaaaactatgttgaccttgttatccagtgagaggctttgtgacattcatttaaattgtaataatttgcagattatttttgtataatcatgtcctctgtgaatgacagttttatttcttcctttcttaatctttatgccttatttagctcttgccaaactgcagtggctgagcaattggacaagataaagaaataaaagtgatccagatcataaagaaagaagtaaaactatatctgcacatgacataatcttgtctatggaaaatcctaaggaatccacacacaaaaaaactactagagctaataagtttggcaaggttgcaagatataaaattggtatacaaattgcagtggctaggacctccagcagaatgctgactataagtagtgatagtgggtattcttgtccatcctcaatctcaggggtggtgggtgtggcatgtggagagttgtcaatattcaccatgaagtttgatggttgttataggatttttaatgtactcattaacatatattctcaagctgttaaaaagatttttttaattacaaataaggttaaatttctctcaaatacttactctgcaccttttgaaataattttatttttctcctttattctttggatgtgatgacttatactaattgactgttgaatgtcaaaccaaacttaacattcttgtaatagaaaccagcagggtgtgt

SEQ ID NO: 188227 - DNA, 1900 bp, Homo sapiens
  Payload ID: 17041
  Gene Symbol: SYTL1
  Gene Name: synaptotagmin-like 1
  Uniprot ID: Q8IYJ3
  ENST ID: ENST00000318074
  CDS Start-End: 168-1820
agctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagcaa

SEQ ID NO: 188228 - DNA, 312 bp, Homo sapiens
  Payload ID: 17041
  Gene Symbol: SYTL1
  Gene Name: synaptotagmin-like 1
  ENST ID: ENST00000473280
  CDS Start-End: 84-312
tgcccctcagcgctgggcaaatgctttctttccggagtcactgtggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctga

SEQ ID NO: 188229 - DNA, 2229 bp, Homo sapiens
  Payload ID: 17041
  Gene Symbol: SYTL1
  Gene Name: synaptotagmin-like 1
  Uniprot ID: Q8IYJ3
  ENST ID: ENST00000543823
  CDS Start-End: 463-2151
gtgtgtgcatgtctctcgtgggcatgggtccgggtctgtgtctgcagagggccctttctgggggaacagctgtgcatgcgcctgtctttatgcaggtgtctgtgtgcatgtgcgaccatatctatgcctacatggacccgcgtgtgcacatgtgtctgtgtgttccatcgctgcagtcctgtgtggccctacctcagggtgtgtgcatgtgtgtctcttgcttcttccactgtgtctccaagtgtgttcaagggctagtgtatgcatgtgtgcatgagtgtctctcaccccaccttgagctcagccatcctggggtggcaccctacccatacccggccaagtgtttggggagaaaagggctgttggttctaggatgtgccaagcatttgtgcagggcttgacctgaccctcggtctgcccccaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagc

SEQ ID NO: 188230 - DNA, 1878 bp, Homo sapiens
  Payload ID: 17041
  Gene Symbol: SYTL1
  Gene Name: synaptotagmin-like 1
  Uniprot ID: Q8IYJ3
  ENST ID: ENST00000616558
  CDS Start-End: 149-1837
tgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcct

SEQ ID NO: 188231 - DNA, 1712 bp, Homo sapiens
  Payload ID: 17041
  Gene Symbol: SYTL1
  Gene Name: synaptotagmin-like 1
  ENST ID: ENST00000618673
  CDS Start-End: 170-1663
gcagctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttgg

SEQ ID NO: 188232 - DNA, 4293 bp, Homo sapiens
  Payload ID: 17042
  Gene Symbol: SYTL2
  Gene Name: synaptotagmin-like 2
  Uniprot ID: Q9HCH5
  ENST ID: ENST00000316356
  CDS Start-End: 566-3373
cacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagcagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaa

SEQ ID NO: 188233 - DNA, 4123 bp, Homo sapiens
  Payload ID: 17042
  Gene Symbol: SYTL2
  Gene Name: synaptotagmin-like 2
  Uniprot ID: Q9HCH5
  ENST ID: ENST00000359152
  CDS Start-End: 345-3152
gtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagcagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatct

SEQ ID NO: 188234 - DNA, 1943 bp, Homo sapiens
  Payload ID: 17042
  Gene Symbol: SYTL2
  Gene Name: synaptotagmin-like 2
  Uniprot ID: Q9HCH5
  ENST ID: ENST00000389958
  CDS Start-End: 377-1474
acagaagaatagagaggctgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgat

SEQ ID NO: 188235 - DNA, 4299 bp, Homo sapiens
  Payload ID: 17042
  Gene Symbol: SYTL2
  Gene Name: synaptotagmin-like 2
  Uniprot ID: Q9HCH5
  ENST ID: ENST00000389960
  CDS Start-End: 596-3328
acgccgctctgcgttgacagtgccgggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggaggtaggtgatgctctgatgctgctgcctcttatgaattgacgacaggtgcagagagagaataaactgtgtctaagactggaccagagagtgagtgtgctggaagccaccataggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaattagcgtgacttctcattttaaataaaatattttaggaattctaaacatct

SEQ ID NO: 188236 - DNA, 3536 bp, Homo sapiens
  Payload ID: 17042
  Gene Symbol: SYTL2
  Gene Name: synaptotagmin-like 2
  Uniprot ID: Q9HCH5
  ENST ID: ENST00000528231
  CDS Start-End: 279-3083
ggaacaagcgacctgtttggcaaggaatacagcatccttctgagagcctcttctcgacactatcccacagaccaggacttcctcatgggaaagagcacttaggatcttgctatcagctgccctaaacttttgctgagccaaaataagactttgatgcagaactgaacaagatatttcatttttgtgtgttttaatcttcctggttgcagtcttagttgttcagccctgagaattttgagccacatttgttgctattatttttgcatgcacttttcaaaatgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagac

SEQ ID NO: 188237 - DNA, 583 bp, Homo sapiens
  Payload ID: 17042
  Gene Symbol: SYTL2
  Gene Name: synaptotagmin-like 2
  ENST ID: ENST00000532221
  CDS Start-End: 375-583
ataaaccctaggcactgggggtatgaagataatgatacacatgtctaccctcagggccacaatattttaaataataatttcccaacagtctttggatatgctaatagggcttaatgaggaaagcagctaaacggaggagccattagatagaaaaccaatgtgctgatggctaaaagtcagtgacatgtagtgggaaacctgaaactttgcttatgaggtcctcctgccagcagtgaaggtgctgaactttggcacatgacttgacaaattcttaagaactgcctaggaaagaagagagtccaggcttcagctctttttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagt

SEQ ID NO: 188238 - DNA, 633 bp, Homo sapiens
  Payload ID: 17042
  Gene Symbol: SYTL2
  Gene Name: synaptotagmin-like 2
  ENST ID: ENST00000524911
  CDS Start-End: 444-633
gcagaactctttgtaaaggcaggaagagtggagtgaattcctgggttaagttattcttctgtttgattctcaagtctcagcatttagatctctctgggcacaactggtaaaatcttaaattcaaaggaaagagtcccagaacaagggtgggaaatcgtgcctctgcttatataaataactaaatatagacagagggtgaagttgattctgaatataatggagccagaagatcttgaagcttgtcagtggatcagatgagaaaccagatcagaagccagttacaaatgaatgcgtaccaagaatgaaggtgctgaactttggcacatgacttgacaaattcttaagaactgcctaggaaagaagagagtccaggcttcagctctttttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggag

SEQ ID NO: 188239 - DNA, 711 bp, Homo sapiens
  Payload ID: 17042
  Gene Symbol: SYTL2
  Gene Name: synaptotagmin-like 2
  ENST ID: ENST00000529534
  CDS Start-End: 246-711
ctcaagtctcagcatttagatctctctgggcacaactggtaaaatcttaaattcaaaggaaagagtcccagaacaagggtgggaaatcgtgcctctgcttatataaataactaaatatagacagagggtgaagttgattctgaatataatggagccagaagatcttgaagcttgtcagtggatcagtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaat

SEQ ID NO: 188240 - DNA, 1441 bp, Homo sapiens
  Payload ID: 17042
  Gene Symbol: SYTL2
  Gene Name: synaptotagmin-like 2
  Uniprot ID: Q9HCH5
  ENST ID: ENST00000533892
  CDS Start-End: 271-1281
aaccctctaacccttgggagtctgtgtgcagcagtgatgtgagctgcatccgggctgaaatgggagctcccgctatggcactggctcaaggagctaatctaaagagaaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattac

SEQ ID NO: 188241 - DNA, 2727 bp, Homo sapiens
  Payload ID: 17042
  Gene Symbol: SYTL2
  Gene Name: synaptotagmin-like 2
  Uniprot ID: Q9HCH5
  ENST ID: ENST00000525702
  CDS Start-End: 690-1820
tttaaccattctaactttgccttgggatattgaaaattctgaatcagtgaggtatctaaataatttatattttcaaaaaataatgtttattttataattctgagtgtaaaacactatcagaaaagtaatcctcatgctcactaaacaaacctactctaagacactcaacaaccagaacagttttattattgagttgtgtacaaaaatcttgactgtccagatgaaatagtttttcagcctgcagtgtgttagtgatatatctcaaggagatgaaccaataaagtacagactttgtggtctgaagctctgttgtgaaaaaataagctaaaccaattcacactgacagtataatttgattcaagtgcagctccagttcaataaaaactaatgtttttaaaattaactttgttttgtatttggttcaactccttgctagttctctctctatataatttataaaaactgcatgttgctaatctcatgatcctgtgcatgtggactactctgcctttaacttttttacaaaaacatgtttgttcatagattaaataaaagtatgttttcaacttaatgtctaatgttttctgacaattgtaagaataattttgaaatggaaatgctgctgtttagtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaa

SEQ ID NO: 188242 - DNA, 3049 bp, Homo sapiens
  Payload ID: 17042
  Gene Symbol: SYTL2
  Gene Name: synaptotagmin-like 2
  Uniprot ID: Q9HCH5
  ENST ID: ENST00000527523
  CDS Start-End: 232-2940
agtgccgggcgacacccgggccgtgccgccagcgtccgtcgggagagtgaaggctcgcaacgccttgcccgggggaaggtaacgcgccgcgcccggggctgcgcggtttgcaccgccaggccgagggctgggggccagaagacaagagagacggcgaggcgcgctccctgcccggcagcgactcggagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaa

SEQ ID NO: 188243 - DNA, 740 bp, Homo sapiens
  Payload ID: 17042
  Gene Symbol: SYTL2
  Gene Name: synaptotagmin-like 2
  ENST ID: ENST00000526999
  CDS Start-End: 431-740
cctgcacgctcccttccaaatactgatacccactctcacactagcctgccaagattccacttagcagctggtccccagttacatctcttcagttgacttcccaagcaagcctcccagaggcatatgtgaatgatgatgcacacacacaaatatttgttaatgaccatgggtttgggaaggtgttagtcatggctagcatcataccctttacagaagaatagagaggctgttgcagccccgtgctttctcctgctgctggccgattgcttgctctgaactaaccctctaacccttgggagtctgtgtgcagcagtgatatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaa

SEQ ID NO: 188244 - DNA, 585 bp, Homo sapiens
  Payload ID: 17042
  Gene Symbol: SYTL2
  Gene Name: synaptotagmin-like 2
  ENST ID: ENST00000533577
  CDS Start-End: 565-585
tgttgcagccccgtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgatgagaaaccagatcagaagccagttacaaatgaatgcgtaccaagaatatgattttgagtattggatctcttgtggcctctgtacgaaactgtagatgtgaattcatttataacttatttggacctatgaaagaactgttagatttccacagtgcctacacaacctgataatccattttctcaccctgacaaactcaaaaggatgagcaagtctgttccagca

SEQ ID NO: 188245 - DNA, 2733 bp, Homo sapiens
  Payload ID: 17042
  Gene Symbol: SYTL2
  Gene Name: synaptotagmin-like 2
  Uniprot ID: Q9HCH5
  ENST ID: ENST00000524452
  CDS Start-End: 1-2733
atgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatga

SEQ ID NO: 188246 - DNA, 1910 bp, Homo sapiens
  Payload ID: 17042
  Gene Symbol: SYTL2
  Gene Name: synaptotagmin-like 2
  Uniprot ID: Q9HCH5
  ENST ID: ENST00000529581
  CDS Start-End: 311-1441
gtgctttctcctgctgctggccgattgcttgctctgaactaaccctctaacccttgggagtctgtgtgcagcagtgatgtgagctgcatccgggctgaaatgggagctcccgctatggcactggctcaaggagctaatctaaagagaaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgat

SEQ ID NO: 188247 - DNA, 699 bp, Homo sapiens
  Payload ID: 17042
  Gene Symbol: SYTL2
  Gene Name: synaptotagmin-like 2
  ENST ID: ENST00000533057
  CDS Start-End: 328-699
ggagtctgtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgatgagaaaccagatcagaagccagttacaaatgaatgcgtaccaagaagatgagcaagtctgttccagcatttctccaagatgagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaag

SEQ ID NO: 188248 - DNA, 2437 bp, Homo sapiens
  Payload ID: 17042
  Gene Symbol: SYTL2
  Gene Name: synaptotagmin-like 2
  ENST ID: ENST00000532995
  CDS Start-End: 394-696
gtgtgcagcagtgatgtgagctgcatccgggctgaaatgggagctcccgctatggcactggctcaaggagctaatctaaagagaaagtattttggggaagacatcttggttgcacccctcattgcatcttgactaattgcttccaactccgggggcttccagggacaatctcattgttcttttctctccaagggtcagccatgttaaccatttgttaatttcttctgaacagatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccgtggagtttcactgttgttgcccaggctggcacgatctcagctcacagcaaccttcgcctcccgggttcaagcgattctcctgcctcagcctcctgactagctggaattacagatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaa

SEQ ID NO: 188249 - DNA, 683 bp, Homo sapiens
  Payload ID: 17042
  Gene Symbol: SYTL2
  Gene Name: synaptotagmin-like 2
  ENST ID: ENST00000527794
  CDS Start-End: 204-683
atatttgttaatgaccatgggtttgggaaggtgttagtcatgatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaag

SEQ ID NO: 188250 - DNA, 2425 bp, Homo sapiens
  Payload ID: 17042
  Gene Symbol: SYTL2
  Gene Name: synaptotagmin-like 2
  ENST ID: ENST00000530351
  CDS Start-End: 1-1956
gaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgaggtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgat

SEQ ID NO: 188251 - DNA, 4751 bp, Homo sapiens
  Payload ID: 17042
  Gene Symbol: SYTL2
  Gene Name: synaptotagmin-like 2
  ENST ID: ENST00000354566
  CDS Start-End: 1-3831
ctaaaagaaagaatggatgaacccaatgcagaacaggtctataatccctctcagtttgagaatttgagaaagttttgggacttagaagctaattcaaacagtaaggataatgacaagaatattaccaccacaagccaaaaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagagatgaaacttttggaaatacagctctcctcaagaaagctgaaagtggtgagtgccagctaagcacacagaatttgattcagatggctgcagaagattctcatccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatgatgtaagtgctgcattacagaagctgtgtggagaagtatggttaagttatccagctggaagggaagtaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgatttaaattgtattagaaaa

SEQ ID NO: 188252 - DNA, 6672 bp, Homo sapiens
  Payload ID: 17042
  Gene Symbol: SYTL2
  Gene Name: synaptotagmin-like 2
  ENST ID: ENST00000634661
  CDS Start-End: 1-6672
atgattgacttaagcttcctgactgaagaggaacaagaggccatcatgaaggttttgcagcgggatgctgctctgaagagggccgaagaagagagagtcagacatttgcctgaaaaaattaaggatgaccagcagctgaagaatatgagtggccaatggttttatgaagccaaggcaaaaaggcacagggacaaaatccatggcgcagatatcatcagagcatctatgagaaagaagaggccccagatagcagctgagcagagtaaagacagagaaaatggggcaaaggaaagctgggtgaataatgtcaacaaagatgctttccttcctccagagctggctggcgttgtagaagagccagaagaagatgcagcaccagcaagcccgagttccagtgtggtaaatccagcttccagtgtgattgatatgtcccaggaaaacacaaggaaaccaaatgtgtctccagagaagcagaggaagaatccgtttaatagctccaagttgccagaaggtcactcatcacaacaaactaaaaatgaacagtcaaaaaatggaagaactggtttatttcagacttcaaaagaggatgaattgtcagagtcaaaagaaaagtcaactgtcgcagatacttcaatccaaaagttagagaaatcaaagcagactttgccaggcctttcaaatgggtcccaaatcaaggctccaatccccaaagccaggaagatgatctacaaatcaactgatttaaacaaagatgataaccagtcttttcctagacaaaggacagactccctgaaagcgagaggggctccgagagggatcctcaagcgcaactccagttccagtagcacagactcagaaacccttcgttataatcacaactttgaacccaaaagcaaaattgtgtcacctggcctaaccatccatgagagaatttctgagaaggagcattctttagaagacaactcttccccaaactccctggagccattaaagcatgtgagattctctgcagtgaaggatgagcttccacagagtcctgggctaatccatggtcgggaagtaggagaatttagtgttttagaatctgacagattgaaaaatggaatggaagatgcaggggacacagaagagtttcagagtgaccctaagccttctcaatacagaaagccttcgctttttcatcaatcaacctcaagcccatatgtatcaaaaagtgaaacacatcagccaatgacttctggttcttttccaattaatgggctgcattctcattcagaagttttaactgcaagaccacagtctatggagaattcaccaaccatcaatgaacccaaagataaatcatcagaattaacaaggcttgaatctgtattacccagaagccctgctgatgaactgtctcattgtgttgagcctgagccatctcaggtgccaggtggcagttctagagaccgtcagcaaggtaagccccctcctctcccggctctaaaagctaagacatcttcacgttctggtccatatgccactgagataaagaagtcaactgatgattccatatttaaagttctagactggtttaaccgaagttcttattcagatgacaataagtcattcctccaacatccccgaggaatagagtccaaagaaaaaacagactcaaaatcacaggttgctgttgacttggtgacagatgacactactttaagagaaaatggctcaaagaccctatcacccagcaaaattgaattgaagcctgtgagatctgactcaccattccaagcagagggagatatgctggtttctgaaagttgccaagataataatgtgaatatcaaatccaaattcatgaatttgtcccaaaaaggcaccccaaaggaaggcccaggtatattgcaaccatttgaaagctatggcaccccaagtcaagggagtaaaaatatggactatagccaagattcaaaaagcccaggaaaagggaatggggcatctccttcaaatagtaactattcctacagtgttctcaaggaatctgatgcagaaaaccaagttccatgcaacactaataatattggcaacttgggtgaagaagaacccaagtttcatgctcatgaagaaaatagaggacactcagaagtgaattttgactcttcaacagttgtcaaagaaccaggtttgaaagataacatgaatgcagagagaaagagcaaagtaggaaatacctatatcctgaaagcctccttagagccagagaatattaagtcaacacctggggttgccaacaatggctctccttggaagaagcctgaggtccaattccagcaagaagctggtgaggttcccaagaaccaagtgcagagagagaaatacaaaagagtgagtgacagaatatccttttgggaaggagagaaagctggtgctaagataactcatgaaaaacccacatcttcatgtagccaggaacaaccttctgctaaagcatatcagcctgtgaagaagtcacagggtgtatcatccatggacagtttatctacagaccagagtgaatataatcaggccattcccaaacgagtggtcttagatgaggatgatcaagcatcccagctctccaattcttattcctcaaataaatctaaagagaccaagccacaaatagcaggtccatccagatactatctttcagctgagcaatcagataaagtgtctctgtttcagaataagaaaaatgagcctataaaaagatcacaagtggcagacagtttgccttctagaagaaacattactttaccagcactgcaacctccctcaaatgtcgggagtgaacgacatgctccattggagaaagacagacctctagttcgtgaatcaaatgccaactttaaagttatgtccctaaaagaaagaatggatgaacccaatgcagaacaggtctataatccctctcagtttgagaatttgagaaagttttgggacttagaagctaattcaaacagtaaggataatgacaagaatattaccaccacaagccaaaaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagagatgaaacttttggaaatacagctctcctcaagaaagctgaaagtggtgagtgccagctaagcacacagaatttgattcagatggctgcagaagattctcatccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatgatgtaagtgctgcattacagaagctgtgtggagaagtatggttaagttatccagctggaagggaagtaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgtttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatga

SEQ ID NO: 188253 - DNA, 4931 bp, Homo sapiens
  Payload ID: 17042
  Gene Symbol: SYTL2
  Gene Name: synaptotagmin-like 2
  ENST ID: ENST00000389959
  CDS Start-End: 1-2601
ctaaaagaaagaatggatgaacccaatgcagaacaggtctataatccctctcagtttgagaatttgagaaagttttgggacttagaagctaattcaaacagtaaggataatgacaagaatattaccaccacaagccaaaaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagggcatactccaggtgctaccagatgaaatcacatttcctttgagtccacttagaaagtatacttatcagttgccaggaaatgagtcatcaaaggaaaatgtggaaaagaatacggaagggattgttactccagtgtttaaggaagaaaaggattactcagaacaagagattcaagaatccataataaaaaccaatgttttgtctaaagactgcaaagacacttttaatgacagcttgcagaaactgctttcagaaacctcaacaccagcaattcaaccctctggtggaaaagttcatggaaaacaagtgcttgaaccaagtgtttctgaaaataggacatggcctcaaaaaacagattttgctgatactgaggaagaagtcaaaggacctgagaagatcattaatgagcatgttgacaaaacagtagttcatccaaaggttaaacggaactctttgactgctagtctagacaaactcctgaaggaagcaactggaacttcaccctctcccttgcaagccaagttggcgcctgttatcactggaaccaactctaagctggaagaggggagattttttggaaaagggatagaacagagtcacaatacttcagctgataagagagaaatactagctccttttccagtgagagatgaaacttttggaaatacagctctcctcaagaaagctgaaagtggtgagtgccagctaagcacacagaatttgattcagatggctgcagaagattctcatccattggatccaacttcccagctttccagaaagggttcttttggggatgtggccagccctccccaagatatgctttttccccaggatgctcatcttgttccccaggctagggtacacccttctcaaacggaaatttcggagactgtagagaaagtcattcttccacccagacctgtattgaatgatgtaagtgctgcattacagaagctgtgtggagaagtatggttaagttatccagctggaagggaagtaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccagacgcttagctcatttgcttccattgttgctcaatatggcaaaggcctccctcaggaagtggaagaaattgtgagggaaacaattgttcaacccaaatcagagttcctcgaattcagtgctggcttagaaaaactactgaaggaagaaactgaaaccttcccctcaaaatatgaaagtgatacagggaatctttctccatcaaagttaataggtagtacagaggagcccaggcgagccacttctgaatgccatcctgaggaattaaaagaaacagtagaaaaggccgaggctccgttaataactgagagtgcttttgatgctggttttgagaaacttcttaaagaaataactgaagctcctccttatcagccccaggtgtcagtgagagaagaaactcacgagaaggagtcctcacagtcagagcagaccaggttcttggggacagtgccccatttttacagggcagcctcacagacctctgaaatgaaggataaaagtaatggtttggaatctcaagtcaaccaatgtgataaaatgttgggaggagacgcacttgtgactgatttattggtagatttttgtggttccagaagtggagttgagatccctagaaccccacaactttatgtggctcatgaaatagggaccattaaaactgtaacccccccagaggacagggacagtgaaagtggggttgcagggggacaagggactcttcaggaacctggctttggagaggcttctgaagcaattagtgtgtccagaaataggcaacccattcctctcctgatgaacaaagaaaactctacaaaaacaagtaaagttgaattgactctagcatcgccatatatgaaacaagagaaagaggaagaaaaagaaggtttctctgagtctgatttttcagatggaaacaccagttctaatgcagagagctggagaaatccttccagttcagaagaagaacccagtcctgttttgaaaactttggaaaggagtgccgctaggaaaatgccttccaaaagtctagaagacatttcatcagattcatcaaatcaagcaaaagtagataatcagccagaagaattagtgcgtagtgctgaagatgatttttagttgaacaggagaccttaaagaggctaatgaagaagagtcacagtgaggaatggatgaaagcaagatgaaaacctgtcagatgtattctgctgtctcagttgtgaaactgacatttgagctttactttcatgtctctttaatccttctgttaaaatggtatttattctcaatgttgccctcctgagtagatgagaaaccagatcagaagccagttacaaatgaatgcgtaccaagaatttccacagtgcctacacaacctgataatccattttctcaccctgacaaactcaaaaggatgagcaagtctgttccagcatttctccaagatgagagtgatgacagagaaacagatacagcatcagaaagcagttaccagctcagcagacacaagaagagcccgagctctttaaccaatcttagcagctcctctggcatgacgtccttgtcttctgtgagtggcagtgtgatgagtgtttatagtggagactttggcaatctggaagttaaaggaaatattcagtttgcaattgaatatgtggagtcactgaaggagttgcatgtttttgtggcccagtgtaaggacttagcagcagcggatgtaaaaaaacagcgttcagacccatatgtaaaggcctatttgctaccagacaaaggcaaaatgggcaagaagaaaacactcgtagtgaagaaaaccttgaatcctgtgtataacgaaatactgcggtataaaattgaaaaacaaatcttaaagacacagaaattgaacctgtccatttggcatcgggatacatttaagcgcaatagtttcctaggggaggtggaacttgatttggaaacatgggactgggataacaaacagaataaacaattgagatggtaccctctgaagcggaagacagcaccagttgcccttgaagcagaaaacagaggtgaaatgaaactagctctccagtatgtcccagagccagtccctggtaaaaagcttcctacaactggagaagtgcacatctgggtgaaggaatgccttgatctaccactgctaaggggaagtcatctaaattcttttgttaaatgtaccatccttccagatacaagtaggaaaagtcgccagaagacaagagctgtagggaaaaccaccaaccctatcttcaaccacactatggtgtatgatgggttcaggcctgaagatctgatggaagcctgtgtagagcttactgtctgggaccattacaaattaaccaaccaatttttgggaggtcttcgtattggctttggaacaggtaaaagttatgggactgaagtggactggatggactctacttcagaggaagttgctctctgggagaagatggtaaactcccccaatacttggattgaagcaacactgcctctcagaatgcttttgattgccaagatttccaaatgagcccaaattccactggctcctccactgaaaactactaaaccggtggaatctgatcttgaaaatctgagtaggtggacaaatatcctcactttctatctattgcacctaaggaatactacacagcatgtaaaagtcaatctgcatgtgcttctttgattacaaggcccaagggatttaaatataacaaaatgtgtaatttgtgactctaatattaaataagatatttgaacaagctaggaaaattgaatttctgctgctgcttcaaagaaaaagctgccccagagcattaaacatggggtattgttaagaagcaaaatgttcttgtttgccatcatgtgtttcacaccacaattctgtgccacagttaagagggtctggtacccttgcaggacctttgtaggttgtgggaaaaagtcgcagaaagatactcaaagtggagcagggaatggagacagacatcagtgatgataaaaaaaaaaatggaccttaagaaactatttactctgtaatctctaataaaatatggaattccatattagggcaatgagactgaaactactggtgtttttctgccttgagaaaacaaacagttaaaacaagcctcaaatgtattttagtgccacccactggccataggtacaattcagttgttggcttgttttgacttaattctaaaataggtctcaagcctgtatttttatgagtttatttttttaaaaccctgcatatatatgattgtttttcttataactttactatatgaaagcagcataagagtagtcacaaacatgttttgcaacaaagttttaattagaatgtaagttgctcagttatactgttcttcttatgtatgtaaaattttcgtattttgtaaaaacccttagaataaattatcatttgattt

SEQ ID NO: 188254 - DNA, 2292 bp, Homo sapiens
  Payload ID: 17043
  Gene Symbol: SYTL3
  Gene Name: synaptotagmin-like 3
  Uniprot ID: Q4VX76
  ENST ID: ENST00000297239
  CDS Start-End: 195-2027
ggaacctggatctaaggagggaagaggcgttgcccctgctggcatagtcaggtaccagcccagccaggtattgaacgggctgagcttttcatgatggttcctgctgacctggaaacatcttaaatggaagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatg

SEQ ID NO: 188255 - DNA, 2504 bp, Homo sapiens
  Payload ID: 17043
  Gene Symbol: SYTL3
  Gene Name: synaptotagmin-like 3
  Uniprot ID: Q4VX76
  ENST ID: ENST00000360448
  CDS Start-End: 400-2232
aagaagaattgacttccttctctgcagagccggctctggtctcttctcttgaagcagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtcctcca

SEQ ID NO: 188256 - DNA, 2692 bp, Homo sapiens
  Payload ID: 17043
  Gene Symbol: SYTL3
  Gene Name: synaptotagmin-like 3
  Uniprot ID: Q4VX76
  ENST ID: ENST00000367081
  CDS Start-End: 792-2420
aagaagaattgacttccttctctgcagagccggctctggtctcttctcttgaagcagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaaggttagcttctatgagtcactgatactctttttattgctatttctaaatttccttggcttgaaaattacttctgctttgcagaaattatctgcttgcagctgtggataatttataacaatctctggtgaaacctcagaaaagagatatgcttttgtcttagatggatgtcagcagctgctgcagaacccggtgaaaacaccccccgggtagcacgaggctctgcgagccgtaactccgacaaacgcagaacttcttgaggctttcttcttctaaggagtatgacacagttaaaaaggaaaaaagaaccacaagcaaaacagttgccagtgaaataggagagggagctctttaaacaaggctggctgcagctggcctccgccgctcatctgcagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtcctcca

SEQ ID NO: 188257 - DNA, 2896 bp, Homo sapiens
  Payload ID: 17043
  Gene Symbol: SYTL3
  Gene Name: synaptotagmin-like 3
  Uniprot ID: Q4VX76
  ENST ID: ENST00000611299
  CDS Start-End: 792-2624
aagaagaattgacttccttctctgcagagccggctctggtctcttctcttgaagcagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaaggttagcttctatgagtcactgatactctttttattgctatttctaaatttccttggcttgaaaattacttctgctttgcagaaattatctgcttgcagctgtggataatttataacaatctctggtgaaacctcagaaaagagatatgcttttgtcttagatggatgtcagcagctgctgcagaacccggtgaaaacaccccccgggtagcacgaggctctgcgagccgtaactccgacaaacgcagaacttcttgaggctttcttcttctaaggagtatgacacagttaaaaaggaaaaaagaaccacaagcaaaacagttgccagtgaaataggagagggagctctttaaacaaggctggctgcagctggcctccgccgctcatctgcagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacggaagtttaattagcattgacagcacctgtacagagatgggcaattttgacaatgctaatgtcactggagaaatagaatttgccattcattattgcttcaaaacccattctttagaaatatgcatcaaggcctgtaagaaccttgcctatggagaagaaaagaagaaaaagtgcaatccgtatgtgaagacctacctgttgcccgacagatcctcccagggaaagcgcaagactggagtccaaaggaacaccgtggacccgacctttcaggagaccttgaagtatcaggtggcccctgcccagctggtgacccggcagctgcaggtctcggtgtggcatctgggcacgctggcccggagagtgtttcttggagaagtgatcattcctctggccacgtgggactttgaagacagcacaacacagtccttccgctggcatccgctccgggccaaggcggagaaatacgaagacagcgttcctcagagtaatggagagctcacagtccgggctaagctggttctcccttcacggcccagaaaactccaagaggctcaagaagggacagatcagccatcacttcatggtcaactttgtttggtagtgctaggagccaagaatttacctgtgcggccagatggcaccttgaactcatttgttaagggctgtctcactctgccagaccaacaaaaactgagactgaagtcgccagtcctgaggaagcaggcttgcccccagtggaaacactcatttgtcttcagtggcgtaaccccagctcagctgaggcagtcaagcttggagttaactgtctgggatcaggccctctttggaatgaacgaccgcttgcttggaggaaccagacttggttcaaagggagacacagctgttggcggggatgcatgctcactatcgaagctccagtggcagaaagtcctttccagccccaatctatggacagacatgactcttgtcctgcactgacatgaaggcctcaaggttccaggttgcagcaggcgtgaggcactgtgcgtctgcagaggggctacgaaccaggtgcagggtcccagctggagacccctttgaccttgagcagtctccatctgcggccctgtcccatggcttaaccgcctattggtatctgtgtatatttacgttaaacacaattatgttacctaagcctctggtgggttatctcctctttgagatgtagaaaatggccagattttaataaacgttgttacccatgtcctcca

SEQ ID NO: 188258 - DNA, 2335 bp, Homo sapiens
  Payload ID: 17044
  Gene Symbol: SYTL4
  Gene Name: synaptotagmin-like 4
  Uniprot ID: Q96C24
  ENST ID: ENST00000263033
  CDS Start-End: 189-2204
gagggtgagaagggccggctgccggagctgggttgcgatcttcccggagccggagaccctcccttgaaaccggcactgggacttctcgatctctggaggcacctgttgcaagtgacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtg

SEQ ID NO: 188259 - DNA, 3737 bp, Homo sapiens
  Payload ID: 17044
  Gene Symbol: SYTL4
  Gene Name: synaptotagmin-like 4
  Uniprot ID: Q96C24
  ENST ID: ENST00000276141
  CDS Start-End: 188-2203
agtcaccttttcgtgggttcctctcacagcgctcggccgtcgagcggggtcgctaacccgcactctcttcggacctacgacatcgcggcttctctggcgttggccagtcagccacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtc

SEQ ID NO: 188260 - DNA, 4847 bp, Homo sapiens
  Payload ID: 17044
  Gene Symbol: SYTL4
  Gene Name: synaptotagmin-like 4
  Uniprot ID: Q96C24
  ENST ID: ENST00000372981
  CDS Start-End: 188-1237
agggtgagaagggccggctgccggagctgggttgcgatcttcccggagccggagaccctcccttgaaaccggcactgggacttctcgatctctggaggcacctgttgcaagtgacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatggtaagttctattagatctgtggttacaggcatgttggggtactaggaagaaaagaagcacctccctagagcagattcgggacctggggaaaccatcctagtcactcttttcaggtaagtaagatcatttgtttgttcctatcctcaatttagactataggtgcttagtgtacatctaggtgacttcctgagcccccacctggagattattacattacagcttgggacatttttcatcacagctttgtgaacaataaccttaacttatcctctaaaggggtacccaggctatgaagtgagcaagatcagatttcttcatcatagcccattccaaattctcaacattaaaagaaagtgagtgtcatgagaggggctctggcagggttgatcgacatcagggtatggttaacaagcaataataccagtcaggataatgaatttaaagggaacatttaagaatcagggcctggttctgtcataagcatgaagattgatatttagggaaacaggaacaagggtgaacagaatttgttcacactcacacacaggaagagaatgtcagctcgcatgaccgattactaccagaaaggaaggtgccttttcacttctggtggggtttcctccctcccactcactcccagttctggccaaatctcttttctctgtaggccctgataagacataaggtggataagagaaacccacagataattaaggcaccttgttttagttagtaactaacccccttctagctggtgttttagtgtatataacacattccccagatggacttaactgcaccttgcctctgctccctgcccacctcctggggcaggtgaaaatgaacactaaaatttgtaaaaagagttgaggaagagaagctaagaggctaggtgagccatgagctgattcattcacctgaacaattttgagtgctggtagttctctcttaccctctgggtcaaggaatgtcagcagcactggcttattgcaggggcttctgaaacttctgttcagtgactgtggttttatcatgagggaagatgtgagcaatgcgggcgggggagtgtgccttccccagatgttcgtgggtgctttatcttcagagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccgtgagtgcttctggaacctgactgatgctctgagaccagagaccagaccccggcatctgtccgggcactcttgaacagagcttatctgtttctgggggagcagggaggtgtaatgtaggaaaagaaccaggattgggaaaaagcaagaatggcatgtctaagagggcttgaggtgacatttttgacatcacatgtcaccatggcatatctatatggagaggaggaaagtgaaaagcaggcttgagaaaggccagcaaattactcagtgctgtctttggtttctagatatgtgaagacttaccttctgcctgacaagtcccgccaaggaaaaagaaaaaccagcatcaagcgggacactattaatccactatatgatgagacgctgagggtaagtatctagacctcaagggtaggagaacttgttctgtcttgtgccctaagctgtagctattcctctgcaacatgaccaggtgacacgggcttcagtgggccatgtctgtgtctgaggatacattgggtatctgttcacatcctgatctcccagtgaagagaacaaaggtgatctgcctttcctggattgatgtgaagtttgagattcacatggccacaaatctcatgtaaaaaagacatttgagataaggagtctccttggcagttctttttggacaatccagtgttatctcatccacttaagaaaaaatgaattttccaggtcctcctatggaatatggtaggtttttataaaatgagttaagttgaggctttgagtgaggaaactcaaagtgctcagggaacataaagtaatttggtattcaggactagtgacttcaggaatggttgctcaggttttggaataatcttgtctgaagaattacccttaactaatcatcttgggcttttactttcccttcacagtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaaggtagtctgctttaacaactcctgcagtttggatctgaggtagaattgtctgcagtagcctctgctggtctatgttggtagcgtctttgaatgtagtcttctctggagttctagtgccccctgctggtgtttctgagtttgacagcaatttcagaggcatttgtctatcaagtgtgagttctgtgtaaaccaggcaaagtgtgaagccatggttttgctttgaaaaaattttcatatgtgtaccaaactttgtctcctaaccttccagaatctgggtgtatcctaacatcctaactcgcacctcttctccgagctaaccttctgtgtatatcctaatctgtacccttttgccaagccactgctttacttccaagtgggaagtaaagcaattcatggagctccaattgctatgctcttggttacagaggccagggaaatattactttggagatggcacctcgggccacagtgtagcagtatggcataatcatgcctgggatctgagtgcagacctgtgttggaatcctggttctgtcacttgccaactagatgagtcacttaactacaaaataatgtagggaaatcatctggctaagaagaaatagctaaaacagaggacttattcagcaacttcttgattatcagaactacacaatgacatgacaaagttcatcttatttttttttacactagcgttttaaatgtgggatggttttacatggtccatagactttgggaagttagatgagaaactagtcatggtggctgcctctaggaatggagactgaggtagaaggaatatttagttttctctatatcccctttttaagcatttgaactttttaccatattaagaaaattaagcaaaaatggacttatgtacacatgattcaaaattaaaacaacataaagtatattaaaaggaaagtaggttccattccttagaaataaccagtgttaacactacttgtgtatccttctagaaattttttatggctaggtatggtggctcacgcctgtaatcccagcacattgggaggcggaggcaggcagatcacctgaggtcaggagttcgagaccaccctgaccaacatggtgaaaccccgtctctactaaatacaaaaaaattagctgggcatggtggcgcaagcctgtaatcccagctacttgggaggctgaggcaggagaatcgcttgaacccatgaggcggaggttgcagtgagccgagattgcgcctttgcactccagcctgggcaaaagagtgaaactctgtctcaaaaaaaaaaaaaaaaaaa

SEQ ID NO: 188261 - DNA, 3885 bp, Homo sapiens
  Payload ID: 17044
  Gene Symbol: SYTL4
  Gene Name: synaptotagmin-like 4
  Uniprot ID: Q96C24
  ENST ID: ENST00000372989
  CDS Start-End: 333-2348
cacagcgctcggccgtcgagcggggtcgctaacccgcactctcttcggacctacgacatcgcggcttctctggcgttggccagtcagccacagggaactagtaaaaaaagaaaaagaaaaaataaagtgaaagaggcgtgttgtctagtttcaaaggagaggagagaagagactgagtcgccctgtgttgcccaggctggtcttgaactcctaggctcaagagatcctcctgcctcagcctcccaaagtgctgggattacaggcaactctggtagctctccttgtctggttgttttgaagaaagaagagtagaagaaaaagttgagtaaatcatgtcggagttactggacctttcttttctgtctgaggaggaaaaggatttgattctcagtgttctacagcgagatgaagaggtccggaaagcagatgagaaaaggattaggcgactaaagaatgagttactggagataaaaaggaaaggggccaagaggggcagccaacactacagtgatcggacctgtgcccggtgccaggagagcctgggccgtttgagtcccaaaaccaatacttgtcggggttgtaatcacctggtgtgtcgggactgccgcatacaggaaagcaatggtacctggaggtgcaaggtgtgcgccaaggaaatagagttgaagaaagcaactggggactggttttatgaccagaaagtgaatcgctttgcttaccgcacaggtagtgagataatcaggatgtccctgcgccacaaacctgcagtgagtaaaagagagacagtgggacagtccctccttcatcagacacagatgggtgacatctggccaggaagaaagatcattcaggagcggcagaaggagcccagtgtgctatttgaagtgccaaagctgaaaagtggaaagagtgcattggaagctgagagtgagagtctggatagcttcacagctgactcggatagcacctccaggagagactctctggataaatctggcctctttccagaatggaagaagatgtctgctcccaaatctcaagtagaaaaggaaactcagcctggaggtcaaaatgtggtatttgtggatgagggtgagatgatatttaagaagaacaccagaaaaatcctcaggccttcagagtacactaaatctgtgatagatcttcgcccagaagatgtggtacatgaaagtggctccttgggagacagaagcaaatccgtcccaggcctcaatgtggatatggaagaggaagaagaagaagaagacattgaccacctagtgaagttacatcgccagaagctagccagaagcagcatgcaaagtggctcctccatgagtacgatcggcagcatgatgagcatctacagtgaagctggtgatttcgggaacatctttgtgactggcaggattgccttttccctgaagtatgagcagcaaacccagagtctggttgtccatgtgaaggagtgccatcagctggcctatgctgatgaagccaagaagcgctctaacccatatgtgaagacttaccttctgcctgacaagtcccgccaaggaaaaagaaaaaccagcatcaagcgggacactattaatccactatatgatgagacgctgaggtatgagatcccagaatctctcctggcccagaggaccctgcagttctcagtttggcatcatggtcgttttggcagaaacactttccttggagaggcagagatccagatggattcctggaagcttgataagaaactggatcattgcctccctttacatggaaagatcagtgctgagtccccgactggcttgccatcacacaaaggcgagttggtggtttcattgaaatacatcccagcctccaaaacccctgttggaggtgaccggaaaaagagtaaaggtggggaagggggagagctccaggtgtggatcaaagaagccaagaacttgacggctgccaaagcaggagggacttcagacagctttgtcaagggatacctccttcccatgaggaacaaggccagtaaacgtaaaactcctgtgatgaagaagaccctgaatcctcactacaaccatacatttgtctacaatggtgtgaggctggaagatctacagcatatgtgcctggaactgactgtgtgggaccgggagcccctggccagcaatgacttcctgggaggggtcaggctgggtgttggcactgggatcagtaatggggaagtggtggactggatggactcgactggggaagaagtgagcctgtggcagaagatgcgacagtacccagggtcttgggcagaagggactctgcagctccgttcctcaatggccaagcagaagctgggtttatgagtccctgtcctcttctgcaggtccagccctggcgagggcaggtcagaggaagtgaagaaatcaagagcaaagatttataatttaatgtgtatgtgtgtatgtgtgtatgtgtgtgtgtgtgtgtgtgtgtgtatgtgtacaaacatgtattttctgcaaatctcattatgctggctagagtgatgcagacttgttcttctttttaaagcagtctcaagaataagcatttctttaaaatgtttctgtgtataatctagtttattttcagagtccattttttcttatgtctttataaggttcacttaacttaaaaacagcttttaaaacaactttttatcttctgtcttgctatcattgttcctacttccctaggaagccctggctacctttcgcattaggaccagtctgggttttaaggctctgggaagcagggttggttagtaaagacaggaatgttggggagaggtgagtagttccttcctctttctcctctccaatttatgcttttaacttattttctacctggataaacttctggaacttggcttttaaatttaacttttctagtttttaagcagtttccaccttgctttggtctaatgcttttctttgaaatgctaacagaattcccaagctttttccagttctagatatctttactagacctttgggggactcttataatggagctgcttttgaaaagcactttaattagataatgtattttgactaaatcacgaggatgcccagtgagagcttctagctgatctcagaggaccagagtgactgagggtaaagtgtctcacagcccatgctgaattttctgcattttaaactgatactgcagtcattggagagagagctcctcatttctcgaatgaaagatgagatatattcatcctcatgtaccacatctgtcttagtgtttgcgtctggggtgtgttatcaaacagagcatggtctacatcccactgtgtcaaccagaagagccaagtgttatctcaattggcccagtgtttctccaggctggggactgttaagggctctaagggaatgtagacagagtctccctgttattctgacttcctgcttgatgagctttcagttcctgtttttgctattgtttcctaaatttgacctacatattacatgggtgtagtgtgttgaggcttttcaaagaagggtctagtgagctaagtttcatcttctggtactcattgatcaaactgacctttctattctcataagcgtttctacccaaagttgtgtgtggaaggagtgtatagcagagaggaaatccctttcaacagagtcagctgctaactgatttcctataagcacactggattaagggcagccacagtggtttctactgtatgtatgaaccgaatggaggaatgttttcaaagattgatttggtgtggattgcaattgtaatggaaggcataacttgggatcccgggctgtaacttgctcttttgtttcccacccccctgacatgtatgtgtgctttaataaagctttctcacttgtcaaa

SEQ ID NO: 188262 - DNA, 4722 bp, Homo sapiens
  Payload ID: 17045
  Gene Symbol: SYTL5
  Gene Name: synaptotagmin-like 5
  Uniprot ID: Q8TDW5
  ENST ID: ENST00000297875
  CDS Start-End: 444-2636
cacaagggtcaagtagtccagcattctacagtttgtgtgtttgagagaaaaataagcccataaaaacattctaaccttcagattaagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgcagctaaggattataactggtgagtggttttttgaagaaaaggcaaaacgtttcaagcaagtcaatgttctcggcactgatgttgtccgacagtccattttaagaagaagtccaggagctgaagaagtacagagccaagagcaaacccgccaggatgcagaaaagtcagacacttcacctgttgctgggaagaaggccagccatgatgggcccaagagaaagggatttcttcttagcaagttcagatcggcaaccagaggagaaatcataactcccaaaactgacactgggcggagctatagcttggacttagacggtcaacattttcggagtttaaaatcacctcctggttcagacaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagagtatggttttgaaaattccatggatttggctgctattgaaggtacctctcaggagctcacaaagagtcaccgcagaaacacttctggcacaccttccatagcagtgtctggaacctctctctcctcagatcagagtcgatctgagttagatttgagtgagtcatttacagaagactcagaggatactgtaagcataagaagcaagtctgtccctggggctttagacaaggactccttggaagagactgaagaaagcattgatgccttagtgtcctcgcagttatctacaaacactcaccgtctggcaagtggcctatcaactaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcttatgtcaagtcatatcttcttcctgacaagtcccggaacaacaagcgtaagaccaaaatcagaacaggcaccaatccagaattcaatgaaacactaaagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtggagtttgctcctgatattggccttcaatacaaaggagagctgacagttgttttacgttacattcccccagaagagaacctgatgcttccaccagaacaactccaaggaaataagacttttaaaaagggaaagaagaaggagtcacctgtaatctctggaggaatactagaagtgttcatcaaagaggcaaagaatttgacagcagtgaagtcaggaggcacttctgatagctttgtgaagggctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtga

SEQ ID NO: 188263 - DNA, 4704 bp, Homo sapiens
  Payload ID: 17045
  Gene Symbol: SYTL5
  Gene Name: synaptotagmin-like 5
  Uniprot ID: Q8TDW5
  ENST ID: ENST00000456733
  CDS Start-End: 357-2615
tgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgcagctaaggattataactggtgagtggttttttgaagaaaaggcaaaacgtttcaagcaagtcaatgttctcggcactgatgttgtccgacagtccattttaagaagaagtccaggagctgaagaagtacagagccaagagcaaacccgccaggatgcagaaaagtcagacacttcacctgttgctgggaagaaggccagccatgatgggcccaagagaaagggatttcttcttagcaagttcagatcggcaaccagaggagaaatcataactcccaaaactgacactgggcggagctatagcttggacttagacggtcaacattttcggagtttaaaatcacctcctggttcagacaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagagtatggttttgaaaattccatggatttggctgctattgaaggtacctctcaggagctcacaaagagtcaccgcagaaacacttctggcacaccttccatagcagtgtctggaacctctctctcctcagatcagagtcgatctgagttagatttgagtgagtcatttacagaagactcagaggatactgtaagcataagaagcaagtctgtccctggggctttagacaaggactccttggaagagactgaagaaagcattgatgccttagtgtcctcgcagttatctacaaacactcaccgtctggcaagtggcctatcaactagttctcaagcaggttctgacaggaagtggacctacctaaatgtgcctgatgctgactcagacactaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcttatgtcaagtcatatcttcttcctgacaagtcccggaacaacaagcgtaagaccaaaatcagaacaggcaccaatccagaattcaatgaaacactaaagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtggagtttgctcctgatattggccttcaatacaaaggagagctgacagttgttttacgttacattcccccagaagagaacctgatgcttccaccagaacaactccaaggaaataagacttttaaaaagggaaagaagaaggagtcacctgtaatctctggaggaatactagaagtgttcatcaaagaggcaaagaatttgacagcagtgaagtcaggaggcacttctgatagctttgtgaagggctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactc

SEQ ID NO: 188264 - DNA, 1824 bp, Homo sapiens
  Payload ID: 17046
  Gene Symbol: SYNC
  Gene Name: syncoilin, intermediate filament protein
  Uniprot ID: Q9H7C4
  ENST ID: ENST00000373484
  CDS Start-End: 97-1527
gttgcagctggcagtgcggcgggcgcgggcgccggagcgaggggcccgcgggcccggctattaataacgcggccgccagcccggggtcgcgcagccatggccagcccggagccccggcgcggcggggacggcgccgcccaggccgcgaggaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcatggaggagaacctgagcatagaggacctggaattgctagaggggcgtttccagcagtgtgtccaagctgtggcccagctggaagaggagagggatcagctcatccatgagcttgtattgctccgggaaccagccctgcaggaggtacagcaagtccatcaagacatcctggctgcctacaagctccatgcccaagcagagctggagagagatggcctaagggaggagatccggctggtcaagcagaagcttttcaaagtgacaaaggaatgtgtggcctaccaataccagctggagtgccgccagcaggacgtggctcagtttgccgatttccgggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataagggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtgaaggatgaatgtatggacacatctgggagtattttaaagaatgtatcttgc

SEQ ID NO: 188265 - DNA, 3398 bp, Homo sapiens
  Payload ID: 17046
  Gene Symbol: SYNC
  Gene Name: syncoilin, intermediate filament protein
  Uniprot ID: Q9H7C4
  ENST ID: ENST00000409190
  CDS Start-End: 460-1908
cggacacccccaaacactcgcgggagaggggtgctggctccctttgagcagcccgcccaaccctgcctccaccctcccaggctggacagggaaggtgctccctggggcttcagaccccccttctgactccccctgcaacgggacctcacgaaaggaagggtggagagaaggttcgggaagacgagggggctgggaggtttggaaagacagctccaggcccccgttcccacccccgccccaggctggtccgggaggggcagcctctccccgcccccaggtccgcgcggccgctccctcctcccccggcaggagccccggccaagtgggcgcgcccggcccggggccggccgggatccggtgtcggttgcagctggcagtgcggcgggcgcgggcgccggagcgaggggcccgcgggcccggctattaataacgcggccgccagcccggggtcgcgcagccatggccagcccggagccccggcgcggcggggacggcgccgcccaggccgcgaggaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcatggaggagaacctgagcatagaggacctggaattgctagaggggcgtttccagcagtgtgtccaagctgtggcccagctggaagaggagagggatcagctcatccatgagcttgtattgctccgggaaccagccctgcaggaggtacagcaagtccatcaagacatcctggctgcctacaagctccatgcccaagcagagctggagagagatggcctaagggaggagatccggctggtcaagcagaagcttttcaaagtgacaaaggaatgtgtggcctaccaataccagctggagtgccgccagcaggacgtggctcagtttgccgatttccgggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataaggctatgctactacccaagagcctggaacaggctgatgctcccacttctcaggcaggtggaatggagacacagtctcaaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtgaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagatagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttctcaacttgacagtctacctgtggtataactgtcaggtaaaaacatacatctttacaacttggtggtcccaagttaaaaaaaaaaaaaaaaa

SEQ ID NO: 188266 - DNA, 552 bp, Homo sapiens
  Payload ID: 17046
  Gene Symbol: SYNC
  Gene Name: syncoilin, intermediate filament protein
  ENST ID: ENST00000426909
  CDS Start-End: 342-552
cctttgagcagcccgcccaaccctgcctccaccctcccaggctggacagggaaggtgctccctggggcttcagaccccccttctgactccccctgcaacgggacctcacgaaaggaagggtggagagaaggaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagc

SEQ ID NO: 188267 - DNA, 569 bp, Homo sapiens
  Payload ID: 17046
  Gene Symbol: SYNC
  Gene Name: syncoilin, intermediate filament protein
  ENST ID: ENST00000417633
  CDS Start-End: 301-569
agctaagtggaaaaaggaatccgaaggaagaacgcctgaagcccaggtctgggaaggggcccagcagcttctctcttggggagaaagacgaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcatggaggagaacctgagcatagaggacctggaattgctagaggggcg

SEQ ID NO: 188268 - DNA, 573 bp, Homo sapiens
  Payload ID: 17047
  Gene Symbol: SYCN
  Gene Name: syncollin
  Uniprot ID: Q0VAF6
  ENST ID: ENST00000318438
  CDS Start-End: 13-417
ggcactgccaccatgtccccgctgcgcccgctgctgctggccctggcccttgcctccgtgccttgcgcccagggcgcctgccccgcctccgccgacctcaagcactcggacgggacgcgcacttgcgccaagctctatgacaagagcgacccctactatgagaactgctgcgggggcgccgagctgtcgctggagtcgggcgcagacctgccctacctgccctccaactgggccaacaccgcctcctcacttgtggtggccccgcgctgcgagctcaccgtgtggtcccggcaaggcaaggcgggcaagacgcacaagttctctgccggcacctacccgcgcctggaggagtaccgccggggcatcttaggagactggtccaacgctatctccgcgctctactgcaggtgcagctgatgcattgctggtctctcatctgcagcttccacagagtgccaagcccctcactcagcccatccctgggctctgctccggggccccaagacccaggaggaggagcgttctgcctgccccctcccacctcccctgcaatacagcctttgtgcagttgtc

SEQ ID NO: 188269 - DNA, 3147 bp, Homo sapiens
  Payload ID: 17048
  Gene Symbol: SDC1
  Gene Name: syndecan 1
  Uniprot ID: P18827
  ENST ID: ENST00000254351
  CDS Start-End: 246-1178
ggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaa

SEQ ID NO: 188270 - DNA, 3291 bp, Homo sapiens
  Payload ID: 17048
  Gene Symbol: SDC1
  Gene Name: syndecan 1
  Uniprot ID: P18827
  ENST ID: ENST00000381150
  CDS Start-End: 392-1324
ttcagcccctctcccgggctgcgcctccgcactccgggcccgggcagaagggggtgcgcctcggccccaccacccagggagcagccgagctgaaaggccgggaaccgcggcttgcggggaccacagctcccgaaagcgacgttcggccaccggaggagcgggagccaagcaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggc

SEQ ID NO: 188271 - DNA, 1523 bp, Homo sapiens
  Payload ID: 17048
  Gene Symbol: SDC1
  Gene Name: syndecan 1
  ENST ID: ENST00000403076
  CDS Start-End: 230-739
ttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctgtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaa

SEQ ID NO: 188272 - DNA, 591 bp, Homo sapiens
  Payload ID: 17048
  Gene Symbol: SDC1
  Gene Name: syndecan 1
  ENST ID: ENST00000447124
  CDS Start-End: 228-314
attataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgagtctgtctcatgggagatgaggtagggacagtcgtttctgagaccgatgtgtaaagcgccctccctgcttcccagcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctgga

SEQ ID NO: 188273 - DNA, 646 bp, Homo sapiens
  Payload ID: 17048
  Gene Symbol: SDC1
  Gene Name: syndecan 1
  ENST ID: ENST00000429035
  CDS Start-End: 1-646
ccgcgttggcccggggagccgggccagggctgcgtggggggcgcgggcgagcgtctgcagggccctcgggcttgccgtgggcggctcgagcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatctggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctgggg

SEQ ID NO: 188274 - DNA, 3759 bp, Homo sapiens
  Payload ID: 17049
  Gene Symbol: SDC2
  Gene Name: syndecan 2
  Uniprot ID: P34741
  ENST ID: ENST00000302190
  CDS Start-End: 922-1527
agaaaagctacatacgtctctcgtttcttcactaattgttctctagaaaagggaaagtgaagaagggaaagagaaaagacaacggggaagaaaagagcatagaggagagaggaaaagtggggagagaaaggaagaaaaggactgagaaaacgcaggagccctggcttgccggtgagcagagccggcgcagccacagcgcggagccgcggcgcccactggtcctcggagctgccaatcggcgtgtaatcctgtaggaatttctcccgggtttatctgggagtcacactgccgcctcctctccccagtcgcccaggggagcccggagaagcaggctcaggagggagggagccagaggaaaagaagaggaggagaaggaggaggacccggggagggaggcgcggcgcgggaggaggaggggcgcagccgcggagccagtggccccgcttggacgcgctgctctccagatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcgagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgcaacagcaaattaatgtgtaaaattggattattactacaaaaccgtttagtcatatctatctaatcagatcttcttttgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcctaatattgaaaatgtcactgttataaattttgtacatttttgatcaaatgtacatctcccctttgctaacggccgtctgctctcaaggatgacgtgggtttgatttctaagtgtttcacagtgtctgtaaatcaagaccaaagagcctgtcgatgagactgtttattaccagattcacttctgaattggccagaggaaatctgaatgtattatcctgtgtgtgtctaggtagagatattggaaggctgccaggggatttcgaagtttgcaacctttataggataactgatggcaatattaagacagacgcctgcttttgcaaataacttacaagactgtaaattccaaagatctgaatggggctttcctgatgttggtatctaaggcttaggcctatagattgatttacctttggaattgtgctccaaatgtctactgaagcttaaccgaagaactaataaatggactacagtagctcacgttacagggaaggagggtaggcagggaggctctgtgtgttaaaatgagggtctcactgctttaggattgaagtggctggaaagagtgatgcctggggaaggagatggagttatgagggtactgtggctggtactttctgtactaaacatttcctttttctattttaccactaattttgttttaaactgtgagccgtccaagtcagaagaagacagcaaaaaaagcaacttttccaacatacaatttacttttaataaagtatgaatatttcattttgagaacattccctggaattgccacataattcattaaaaacatttttttaagcaacacttggaacagtgtttactttaaatccttaatggccttaattaattctcagattcctgccccatcacttacagaaccaattcactttagagtgactaaaaggaaacgatagcctagctttctaaagccacgctgtgtccctcaattacagagggtaggaatgggtatacctctaactgtgcaaagcagagtgaaattcaattcatagaataacaactgctgggaatatccgtgccaggaaaagaaaaatttctggcaaatattttgtcactgctgtaaagcaaaatatttgtgaaagtgccaaaataaagtctgtcatgccaaaagtaaatcattgta

SEQ ID NO: 188275 - DNA, 677 bp, Homo sapiens
  Payload ID: 17049
  Gene Symbol: SDC2
  Gene Name: syndecan 2
  ENST ID: ENST00000522911
  CDS Start-End: 64-582
gcaccaactccgtgtcgggagtgcagaaaccaacaaagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcat

SEQ ID NO: 188276 - DNA, 1318 bp, Homo sapiens
  Payload ID: 17049
  Gene Symbol: SDC2
  Gene Name: syndecan 2
  ENST ID: ENST00000519914
  CDS Start-End: 248-766
gtctttgttccagagcatttgccaaagccaggtatgtccagtcaaagggataatgcaaccgatagctcccaagcctccatatcctcagctgttgcttgttgccactgaggggtggacatgttttcatttggcatcttacatgtgagcatcatgactacagactcatcttataccaattaaataataaactccactctgtgggcagaggttctgtctggagagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtat

SEQ ID NO: 188277 - DNA, 1583 bp, Homo sapiens
  Payload ID: 17049
  Gene Symbol: SDC2
  Gene Name: syndecan 2
  ENST ID: ENST00000518385
  CDS Start-End: 460-957
agatacccccggagctccagccgcgcggatcgcgcgctcccgccgctctgcccctaaacttctgccgtagctccctttcaagccagcgaatttattccttaaaaccagaaactgaacctcggcacgggaaaggagtccgcggaggagcaaaaccacagcagagcaagaagagcttcagagagcagccttcccggagcaccaactccgtgtcgggagtgcagaaaccaacaagtgagagggcgccgcgttcccggggcgcagctgcgggcggcgggagcaggcgcaggaggaggaagcgagcgcccccgagccccgagcccgagtccccgagcctgagccgcaatcgctgcggtactctgctccggattcgtgtgcgcgggctgcgccgagcgctgggcaggaggcttcgttttgccctggttgcaagcagcggctgggagcagccggtccctggggaatatgcggcgcgcgtggatcctgctcaccttgggcttggtggcctgcgtgtcggcggagtcggtgagagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaaggatgaaggaagctatgaccttggagaacgcaaaccatccagtgctgcttatcagaaggcacctactaaggagttttatgcgtaaaactccaacttagtgtctctatttatgagatcactgaacttttcaaaataaagcttttgcatagaataatgaagatctttgttttttgttttcattaaagagccattctggcactttaatgataaaatcccattgtatttaaaacatttcatgtatttctttagaacaacataaaattaaaatttaacatctgcagtgttctgtgaatagcagtggcaaaatattatgttatgaaaaccctcgatgttcatggaattggtttaaacttttatgcgcaaatacaaaatgattgtctttttcctatgactcaaagatgaaagctgtttcatttgtgtcagcatgtctcagattgaccttaccaagttggtcttactttgttaatttatctgttgtccccttcctctcctctgccctcccttcttgtgcccttaaaaccaaaccctatgccttttgtagctgtcatggtgcaatttgtctttggaaaattcagataatggtaatttagtgtatatgtgattttcaaatatgtaaactttaacttccactttgtataaatttttaagtgtcagactatccattttacacttgctttatttttcattacctgtagctttgggcagatttgc

SEQ ID NO: 188278 - DNA, 507 bp, Homo sapiens
  Payload ID: 17049
  Gene Symbol: SDC2
  Gene Name: syndecan 2
  ENST ID: ENST00000521590
  CDS Start-End: 97-507
aattcaagacaaaggttgcttcccttctgtctctggatcaggaatctgaacccattaccacaaacagaaagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctg

SEQ ID NO: 188279 - DNA, 621 bp, Homo sapiens
  Payload ID: 17049
  Gene Symbol: SDC2
  Gene Name: syndecan 2
  ENST ID: ENST00000523877
  CDS Start-End: 186-621
agaacacaacggcggtcaagggagaggacgcagaaagatcaggctcaggcctgggtcttgggcatcttcaaggaactcgctttctcagtggtataagaagagccccactctataagaggcatccaacaggaacagccaacatcagtggcaccttccaaagagcagagctgacatctgataaagacatgtaccttgacaacagctccattgaagaagcttcaggagtgtatcctattgatgacgatgactacgcttctgcgtctggctcgggagctgatgaggatgtagagagtccagagctgacaacatctcgaccacttccaaagatactgttgactagtgctgctccaaaagtggaaaccacgacgctgaatatacagaacaagatacctgctcagacaaagtcacctgaagaaactgataaagagaaagttcacctctctgactcagaaaggaaaatggacccagccgaagaggatacaaatgtgtatactgagaaacactcagacagtctgtttaaacggacagaagtcctagcagctgtcattgctggtggagttattggctttctctttgcaatttttcttatcctgctgttggtgtatcgcatgagaaagaagg

SEQ ID NO: 188280 - DNA, 6392 bp, Homo sapiens
  Payload ID: 17050
  Gene Symbol: SDC3
  Gene Name: syndecan 3
  ENST ID: ENST00000336798
  CDS Start-End: 1494-2648
gcccagcgctggcgcagtgagaacttcgagagacccgtggacctggagggctctggggatgatgactcctttcccgatgatgaactggatgacctctactcggggtcgggctcgggctgtaagtacccccctccctacctctgcctgggggcagtgaccagtctgtatccagcctcaactctgagaagcccacggggggcttgcttcagtgaggcagggggcattcactgcctgggtcaggcaagttcttcttgctctggatccccagaacaagaagggcagaacatccttctggggatagaacaagacctgggaggacctcagggcccagaatgtccaggtctccagggtcccacgtctgcatctttgtgtgtgctatgtggctttctctgcagaccttgcttggttccggtggtcccgtcaggtgcaataagctgtggccaatggtggggttagggcagtgatgacacagggcaggtgcttcaagtggtgcctgggatggccccgccctggggaaggggagccaggtcagctgggtctagcagaatctcgggagagaagggcaccgcgaaccccactctgccatgtagcaactgtgtgcccctcggtgctccccctccctgaatccctgtattttcacctgtggatggtgagaaatacgacttcttctcagtgcctctaggagggtttgggataggaagctggggtctggcacagaggaggagctctcaaaatggtagcaaaaagaaggcagctgagactgggcccagtgagggcacgggctggcatctgaggagatggtacggggtctgcacgccacagagctggctccccacagccctcgcctctggtctcccctccttagccaagtcctttgagcctctttcaaattaatctttgtaaaacccgtttatattgggtcacatctctattcgcaaagttccctggctcccctccctcctgcctggttccgagcccaggagctggctgtggcttctccctcccccatcccctactccccatctcatttcctcccaagttccttcactgtcccggctttgcgtcagccagattgctcaagcagttcccctgcctcaagggcttcttttcccttttaccctccgcctctgcctctgggggaagcccttagtgtaccacccctgccttgagcttgtggtaggggtgcctttggggtctgactcttcccagaatgccactcctgtgttcccctgcaagccccagcaagttttgcagccagtagcgcctcagttgctgctgcctggattcaacctcatagaaactgtaggctgggtgggcaggaatagtcaaggaaggcttcccgggagaggcggcccccagaatttttgacttggcagagagaagttggggaacatcagcaactgaccacctttagctgggctgtgccttcctcctttctctcatcttttctgggaaaattgggtaaagagagggggttgggagacctaatcttgatggccattgcttacctgggatcctcatgcccctcacaaccacccagctccctagctctctccctctcccccaccccctcagacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagcctgggactgggcctggaacctggccccagttcttctctgccctctctcccaaggtctgcccaggctgccagcctcacacagatcttccccgaggaagaggggctgctgccatctgccccagactgtgcccttacgagctcatctcttgttcccctcatccctgccaccagtctggggcttcaggacctcatgtcagatggatgggaggaagaaagctcctgattggctggtggtggaagaaagggtggggcttgagatgagcctgagccctgacttggcacccacagtgctcactgagatctcctttttggggcagagaggcactcaggctggtttccaggacaaacatttggtaaacacagcccttgaaatcatctagacactgcaacctcttgctcgtatcccagggcctctctctagctgggtgagagggtgtcccttgtcaccagcctgttttgtcctggtctctctggggttgttgaatctctcctcttgcctgccaagtacacatgtacccagacttcatttctttctgcatcttcccccaagaaacagcttcctgagggtgctggggcagccactggtgaggaggggctgctctgatgtccctcctatgaggggactctgcacagacaccattgcccacactatcaccatattttcactcagtcacacacaagacaaaagcatgcaatgacaaaaccatacgcaatcctgaccgcccagccaatcaagacatatcacagaacacacgcgtccttccaagaatgtttatcctcatgcatcacttacacacccccagacacgtactgcaatgcaagtcactagtcatggtcacatgacagtgacagtgtggcctcctcctaccccaaatacacccacactctggcaccacacacattgtctccagctttcaggcttactggggagggtggaatcgagccagaacaatcagcccatattgggtccccctaagttgccccgtcatactcagtcccatgccatggtgcccacaccaaccatgcagccgccaaccccagccagtgtcagacacaatcccatgtggatgcacagtctcactccacatgacctgctctcaatgctggagggaaacaggcaggcccttgcctttctcggaaaaagtgtggggccacagcccttttagggcattgcatgcaggtgggcctggcttcacccctacctgcttcctccccaccgcagctggcagagggggaggtttggggccagacccccactagctgggagcctgggggctcctctaaggctgaggaaggaaatttggccccaggttgttggggggtcttgggtctcccaggacggaaggcccagggcagggagggggcatgtggttgggctcctttatctccctgtgtccccttcctgctttgagctagggggctgactctgcctcccaggacacaagtctccaaagtgcctgtgagggcgggccctccgcaccctctgccctctgcctggcaggccaacctcagcccacctgcccagaggccctccctgtggacaccccctcacctatttggccaaacaattctggctgcagcttcaggggccatggctggaagcagcccctgcagatccctcaggccccgaggtcagggtttgagggatgagaccaggtgatagtgggggaggggttacttcctttgttacctagcaagtagggctatttccatcggtattttaaatgtggggtcacagatcttttggggagggtgtgcttggcagggggcctcttggagccaaagggatgtggtgtgagttgcgattggctggcactcacacccccacccctcacccacatcccagattcaagtcaggaaggcaggttttatttcagggcccttttcaagatgccctggcagcagatttctgcaggatgaggggtagcggtgtgtaggcagtgagggggaggttccaggggctgtcccacagcctgtcttttccaggctgggctccatcttccagtcccaaaaccctccttcacagggcccagaggcttgtgaggaagccaggtggacccagccttagaagagtgggcatggggggcccctgatatctggagggggcgggttggcctcagtcatctttggagcagaagggctgggtcctggggccacagaccacaaggctcagcctccctaccctgctccctggggtgctgctgtcttggagagcacagctctggtgagacggcctgggcaggccgaggctgagaaaccagggaggatagaggagaaaagggcttgggcccccagccccagaagatgctggaccccaggtgggagacccaacagtgggtgcagtttctcagtagggctggagccaatggtgggggtggccccggcaggcctggctcctcacatcccaggggttggcttctgatttggggcttgggctccaggcactggcttctcttctctgtgtccttagcatttgagagaagaggccaggggccttgttcatggatccctggacccaaggcagatgtccaggctttatcctcctgaggatgaggagtctgaccagcccaaatctgccctggccggcctgaccggggcaaggcagtccaagagagttcagtgaggaccagctaggctctcccaggtgcaatgtgggtgcagggccctcatgtccccctacccctgcctgtgatggagtgttctgaggggctttggcatttgctggaagcacagggagttccaaatgagagggagcttctgtggcttgagagcctctggggccttggctgccagagcacgaggcaggccaggacctggagagcccagaccctgtctccaggaggccaggaggccagatgggggccttgcctgaaagactggtccccttgatcgctggaggcatgtgggtggcaaccagggctgggcagggcttagggtgtgtgggccaaacccccctggggttggcaaagccgcctgtcaggcctcctggtgggggcccctggacacagggagcagaccctctgcctcatggggtaggagtggctgcctcctgtgttctctggatttcttctcccaacaactacaaccctggacttgcctccccaggcctcttgcctgtaaatagaagcccgcaaactgtacagatttacagaggcatcgagactgggccctgggagttgccatctgagagccgatggccccagcatcccccaggtgcctgcctggcaccacagtgaccctggcctcagcgtggcaaatgcatgtaaatatttttcgtaggcagcgtggctccagagagccccctgaagacagtgtccctccctcctgtgagtcctttctcctgtacagaacctgcctggggtgggtgggggtctgccattccctcccccaggccttccctgccccttctctcccctgtaacctgtttattaaccatacctgtcctgagttcatggccaaaaccttaaataagaaaaacaaaagaaaaagacagtggaaaaaagagaccaaggcgcctgccccactgcgggtactctcctgttccagccttgtgaaggaactggttttgtttttgtttttttttttttttttttttttttgtttgtttgtttttttaacacttcctgtgctgtgcccatttataagaggaaataaaattaagctgaaatg

SEQ ID NO: 188281 - DNA, 1580 bp, Homo sapiens
  Payload ID: 17050
  Gene Symbol: SDC3
  Gene Name: syndecan 3
  Uniprot ID: O75056
  ENST ID: ENST00000339394
  CDS Start-End: 176-1504
gctgtgggcgcggagctgcgaggcggagccgggcggccgagccgggagcccgcgagcctagagcgcgtcggtccagccgccgggccgcgccgccgccaagcagccgccccgcgcgccgcgcctcgggaacaaaggcgcccgcccgccgcccgccgcccgcgcccgcgccgccgccatgaagccggggccgccgcaccgtgccggggccgcccacggggccggcgccggggccggggccgcggccgggcccggggcccgcgggctgctcctgccaccgctgctgctgctgctgctggcggggcgcgccgcgggggcccagcgctggcgcagtgagaacttcgagagacccgtggacctggagggctctggggatgatgactcctttcccgatgatgaactggatgacctctactcggggtcgggctcgggctacttcgagcaggagtcgggcattgagacagccatgcgcttcagcccagatgtagccctggcggtgtccaccacacctgcggtgctgcccaccacgaacatccagcctgtgggcacaccatttgaagagctcccctctgagcgccccaccctggagccagccaccagccccctggtggtgacagaagtcccggaagagcccagccagagagccaccaccgtctccactaccatggctaccactgctgccacaagcacaggggacccgactgtggccacagtgcctgccacagtggccaccgccacccccagcacccctgcagcacccccttttacggccaccactgctgttataaggaccactggcgtacggaggcttctgcctctcccactgaccacagtggctacggcacgggccactacccccgaggcgccctccccgcccaccacggcggctgtcttggacaccgaggccccaacacccaggctggtcagcacagctacctcccggccaagagcccttcccaggccggccaccacccaggagcctgacatccctgagaggagcaccctgcccctggggaccactgcccctggacccacagaggtggctcagaccccaactccagagaccttcctgaccacaatccgggatgagccagaggttccggtgagtggggggcccagtggagacttcgagctgccagaagaagagaccacacaaccagacacagccaatgaggtggtagctgtgggaggggctgcggccaaggcatcatctccacctgggacactgcccaagggtgcccgcccgggccctggcctcctggacaatgccatcgactcgggcagctcagctgctcagctgcctcagaagagtatcctggagcggaaggaggtgctcgtagctgtgattgtgggcggggtggtgggcgccctctttgctgccttcttggtcacactgctcatctatcgtatgaagaaaaaggatgagggcagctacacgctggaggaacccaagcaggcgagcgtcacataccagaagcctgacaagcaggaggagttctatgcctagtggagccacagtgcctccctgcagcctcaacaccaccctgctgtccagtccccagcctggccccaccagcccaagc

SEQ ID NO: 188282 - DNA, 2613 bp, Homo sapiens
  Payload ID: 17051
  Gene Symbol: SDC4
  Gene Name: syndecan 4
  Uniprot ID: P31431
  ENST ID: ENST00000372733
  CDS Start-End: 41-637
actcgccgcagcctgcgcgccttctccagtccgcggtgccatggcccccgcccgtctgttcgcgctgctgctgttcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaa

SEQ ID NO: 188283 - DNA, 2167 bp, Homo sapiens
  Payload ID: 17052
  Gene Symbol: SDCBP
  Gene Name: syndecan binding protein (syntenin)
  Uniprot ID: O00560
  ENST ID: ENST00000260130
  CDS Start-End: 151-1047
ggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 188284 - DNA, 1277 bp, Homo sapiens
  Payload ID: 17052
  Gene Symbol: SDCBP
  Gene Name: syndecan binding protein (syntenin)
  Uniprot ID: O00560
  ENST ID: ENST00000424270
  CDS Start-End: 83-961
actcgggcctcagaagtccgtgccagtgaccggaggcggcggcggcgagcggttccttgtgggctagaagaatcctgcaaaaatgtctctctatccatctctcgaagacttgaaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagct

SEQ ID NO: 188285 - DNA, 772 bp, Homo sapiens
  Payload ID: 17052
  Gene Symbol: SDCBP
  Gene Name: syndecan binding protein (syntenin)
  ENST ID: ENST00000447267
  CDS Start-End: 19-753
tagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaa

SEQ ID NO: 188286 - DNA, 2103 bp, Homo sapiens
  Payload ID: 17052
  Gene Symbol: SDCBP
  Gene Name: syndecan binding protein (syntenin)
  Uniprot ID: O00560
  ENST ID: ENST00000447182
  CDS Start-End: 104-997
gggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttaca

SEQ ID NO: 188287 - DNA, 2086 bp, Homo sapiens
  Payload ID: 17052
  Gene Symbol: SDCBP
  Gene Name: syndecan binding protein (syntenin)
  Uniprot ID: O00560
  ENST ID: ENST00000413219
  CDS Start-End: 100-996
ggcgcgcaccgctctcttacactcgggcctcagaagtccgtgccagtgaccggaggcggcggcggcgagcggttccttgtgggctagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatg

SEQ ID NO: 188288 - DNA, 3589 bp, Homo sapiens
  Payload ID: 17052
  Gene Symbol: SDCBP
  Gene Name: syndecan binding protein (syntenin)
  ENST ID: ENST00000523483
  CDS Start-End: 1515-2471
ccgtgccagtgaccggaggcggcggcggcgagcggttccttgtgggctaggtgcccaggagccactgagaacagaagacttgttgctgctctagaggacctatggtagggcagacagaggatgatacagctcagcagcttgtccctacgtgtggcatgaaaggtgttggagagagaatagtggagtatgtgtccaacattccagcacttcagagagctacccccaagggactggcttctgtttcacctgacttggagcacaggcaggagtggacatactctaaaagcccactgatgggaaagggcaccaggttggaggcctctgaaaacaagagagctgggtggcttgcagcagctccagagaacctgaagtaccacagacagatagcacagggagcaaaagattatgagatcctgaaaaaggaaacgaacaagttcatcttgagaatttatacacactggtcgagaagaagcatcctcaggaaaggttcaaaaggcatgcagaatctctagtcaggccgatcagtgaggatctttctctgtacagagccagaccacaaagactgggaggggtgatattttttcaaatgcttggatcccaacatgatgttaaaagacacacaaagaaatagggaaacatggcacaatcaaagagtcaaaatatccaggaacctactttaaggaaacacagatatcttcattatctcagaaggaattcagactaaccaccataaacatgttcagtgacccaaggaaaatgctgcatgaacaaaatggtatcaacatagagattgaaaacgtaaaaaggaaccaaacaaacattgtaacagatgcaatatgcttctttgaccaaattgaaagatttactagaggagtttagcagcagtgtttttcaaggagaagaattagtgaacttgaagccaggtcatttgaaattatccagtcagagaagcaaaaagaaaaaaaataaaaaaagaatgaagacagcctagagtactaatgggacagcatcaattttatcaatgtagattgtatggaagttccatatgttggaaagagaaaggagcaaaaagcttatttgaagaaatactggccaaaacttcccaaactgaaggaaggcagtggacatccagattcaagaagccaaatggactccagagtagaacaatccgaagacatctacatggaaacacactgtaatcaaattgtcaaagaattttgaaagcagcaggataagaacaacttgtcatatacaaaggagattctgtgggactctaagtggatttcttagcagaaaccttgcaggtcagaaagaagtgggatgatatagtcaaactgctggaagaaaaactgccagcaaagtactgtatgtggcaaaacttttctttaaaagtaaaagagaaataagattctcaaaatctgagagagttcatcaccactatatctgacttaaacgccaatgggagtctgttaaatggaaacaaaagtatgttcaacatgaaagtataaaattaaatgataaagctatggacaaatagagacctgcatattattgtaatggtgaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtc

SEQ ID NO: 188289 - DNA, 1097 bp, Homo sapiens
  Payload ID: 17052
  Gene Symbol: SDCBP
  Gene Name: syndecan binding protein (syntenin)
  ENST ID: ENST00000520168
  CDS Start-End: 65-784
cgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggctta

SEQ ID NO: 188290 - DNA, 2076 bp, Homo sapiens
  Payload ID: 17052
  Gene Symbol: SDCBP
  Gene Name: syndecan binding protein (syntenin)
  ENST ID: ENST00000630925
  CDS Start-End: 1-957
atgataaagctatggacaaatagagacctgcatattattgtaatggtgaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtct

SEQ ID NO: 188291 - DNA, 1404 bp, Homo sapiens
  Payload ID: 17053
  Gene Symbol: SDCBP2
  Gene Name: syndecan binding protein (syntenin) 2
  Uniprot ID: Q9H190
  ENST ID: ENST00000339987
  CDS Start-End: 60-938
ctcaacactgggtcagaagtcacggccagacaagaaacggggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaa

SEQ ID NO: 188292 - DNA, 1519 bp, Homo sapiens
  Payload ID: 17053
  Gene Symbol: SDCBP2
  Gene Name: syndecan binding protein (syntenin) 2
  Uniprot ID: Q9H190
  ENST ID: ENST00000360779
  CDS Start-End: 175-1053
atcccagtccaaggtgagtcagctgaacaggggacaggcaccacccttcccagatcaggaagccagctgagagacagggctacgtttcagggagggaaacagattcagcagcggcagcagctggagaaggtcgtggagcagcaccttgcctgcagggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaa

SEQ ID NO: 188293 - DNA, 1261 bp, Homo sapiens
  Payload ID: 17053
  Gene Symbol: SDCBP2
  Gene Name: syndecan binding protein (syntenin) 2
  Uniprot ID: Q9H190
  ENST ID: ENST00000381808
  CDS Start-End: 172-795
gggagaagcgtggactggggacgtggggggacccggggacggctccatcctcctttccccatccctacccccaccccagtgtctcctgaggcacagggtccccacgggccgggctgaccccctgccccctggtgtctgcagacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaa

SEQ ID NO: 188294 - DNA, 1550 bp, Homo sapiens
  Payload ID: 17053
  Gene Symbol: SDCBP2
  Gene Name: syndecan binding protein (syntenin) 2
  Uniprot ID: Q9H190
  ENST ID: ENST00000381812
  CDS Start-End: 140-1018
cccttcccacggctgccttagtacagaatcttataagtcctcctccttcagaggctacaaatggtgttccgaggccaggggagtttaaagctcgatttcacccgcgcagcctccaatccgggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaaccctgtccgcaaaggtaattgattcccccaaaactattgaaaataaaataaaaaggtaactgaaaa

SEQ ID NO: 188295 - DNA, 3960 bp, Homo sapiens
  Payload ID: 17054
  Gene Symbol: SYNM
  Gene Name: synemin, intermediate filament protein
  ENST ID: ENST00000328642
  CDS Start-End: 121-1140
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgagg

SEQ ID NO: 188296 - DNA, 7394 bp, Homo sapiens
  Payload ID: 17054
  Gene Symbol: SYNM
  Gene Name: synemin, intermediate filament protein
  Uniprot ID: O15061
  ENST ID: ENST00000336292
  CDS Start-End: 166-4863
gcccgccccgtccgctaagtgcctgggctctcccgctcgcgtcccagtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaa

SEQ ID NO: 188297 - DNA, 5908 bp, Homo sapiens
  Payload ID: 17054
  Gene Symbol: SYNM
  Gene Name: synemin, intermediate filament protein
  ENST ID: ENST00000560674
  CDS Start-End: 470-3373
aagagtggctggattcggattttggagtgagacggagcatgaagacgctgtgtcctgaggcctttacattctcatcttacttatcccttgtagcgatcctatgagggaggggttatccttactttacagatgaggaaactgagtctgggaggctcaaggaccagctcgtccctgtcctcctgctccctagacccagctggtctcagaccctgcggagctgccatcatctgcatctgtgccctgactcttcagcctctctccctggccttctggagacagacctctgaccggtgggctccatgtgattctgggctccaggacctctcccatgaagatgaccagcacttgctgagtgcggtgtgccaagtcttgtgcaacacgtctcacacagcgtaacgggcagtgtggcaaagtgggtaagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaaccca

SEQ ID NO: 188298 - DNA, 6407 bp, Homo sapiens
  Payload ID: 17054
  Gene Symbol: SYNM
  Gene Name: synemin, intermediate filament protein
  ENST ID: ENST00000594047
  CDS Start-End: 121-3882
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgagg

SEQ ID NO: 188299 - DNA, 3787 bp, Homo sapiens
  Payload ID: 17055
  Gene Symbol: SYNRG
  Gene Name: synergin, gamma
  Uniprot ID: Q9UMZ2
  ENST ID: ENST00000619541
  CDS Start-End: 27-3734
gaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggt

SEQ ID NO: 188300 - DNA, 3406 bp, Homo sapiens
  Payload ID: 17055
  Gene Symbol: SYNRG
  Gene Name: synergin, gamma
  Uniprot ID: Q9UMZ2
  ENST ID: ENST00000610513
  CDS Start-End: 27-3353
gaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggt

SEQ ID NO: 188301 - DNA, 527 bp, Homo sapiens
  Payload ID: 17055
  Gene Symbol: SYNRG
  Gene Name: synergin, gamma
  ENST ID: ENST00000612770
  CDS Start-End: 1-323
agcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtagttttaagaggcattatatttttcttttctgggaaggtgatttatgtagtccctgtttctttacctcgccattatatgtgtgtgtgaaaagtcaatgtagaactcttccttcaagctaagtacagatttggatgttctcaaatatacagtggcttaagagctctggtctggataacaactgtcttgggaggaaaaaacctctttgtcttctaattaaatatcagtatgacaatttcacctgtaagttttctgtatataaatatgttaacattagtaaaatctattcactcagagcaaatgtaataaaggagtttaccatttaa

SEQ ID NO: 188302 - DNA, 8229 bp, Homo sapiens
  Payload ID: 17055
  Gene Symbol: SYNRG
  Gene Name: synergin, gamma
  Uniprot ID: Q9UMZ2
  ENST ID: ENST00000618402
  CDS Start-End: 142-4086
agtcacgtgggcgcgaggccccgccccatcgcccggtccgcggcgaggtggggcctggtgtttgacccggaagtggctgtgttcagctgacagctgctgataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaaaggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggcttgagtgcaatggcacaatctcagctcagtgcaacctccgcctcccgggttcaagcgattctcctgcctcagcctcgtgagtagctgggattacaggcgtgcaccaccacgcccagctaattttgtatttttagtagaggcaaggtttctccatgttggccaggcttgaactccggacctcaggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtggtggctcacgcctgtaatccccagcactttgggaggccgagccgggtggatcacccgaggtcaggagttcaagaccagcctggccaacatggcgagaccctgtctctactaaaaatacaaaaattagctgggcatggtggcaggtgcctgtaatccgagctactcgggaggctgaggcaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagctttacctttaaaatattttcagggtctgttctgaaatcaccccttgttaaacttctctaaccaaaatacaagtgtagaagaatgtcaggcta

SEQ ID NO: 188303 - DNA, 3406 bp, Homo sapiens; identical to SEQ ID NO: 188300
  Payload ID: 17055
  Gene Symbol: SYNRG
  Gene Name: synergin, gamma
  Uniprot ID: Q9UMZ2
  ENST ID: ENST00000614941
  CDS Start-End: 27-3353

SEQ ID NO: 188304 - DNA, 4841 bp, Homo sapiens
  Payload ID: 17055
  Gene Symbol: SYNRG
  Gene Name: synergin, gamma
  Uniprot ID: Q9UMZ2
  ENST ID: ENST00000618176
  CDS Start-End: 57-3731
gctgacagctgctgataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacc

SEQ ID NO: 188305 - DNA, 485 bp, Homo sapiens
  Payload ID: 17055
  Gene Symbol: SYNRG
  Gene Name: synergin, gamma
  ENST ID: ENST00000620424
  CDS Start-End: 110-485
cccatcgcccggtccgcggcgaggtggggcctggtgtttgacccggaagtggctgtgttcagctgacagctgctgataaggtggcggcggcgaaggcagcggcagcttcatgtttcctgttgcaggtgggataagaccccctcaaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttga

SEQ ID NO: 188306 - DNA, 709 bp, Homo sapiens
  Payload ID: 17055
  Gene Symbol: SYNRG
  Gene Name: synergin, gamma
  ENST ID: ENST00000614196
  CDS Start-End: 1-709
gagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctgg

SEQ ID NO: 188307 - DNA, 4050 bp, Homo sapiens
  Payload ID: 17055
  Gene Symbol: SYNRG
  Gene Name: synergin, gamma
  Uniprot ID: Q9UMZ2
  ENST ID: ENST00000616179
  CDS Start-End: 32-3571
gcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccgggcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaa

SEQ ID NO: 188308 - DNA, 3859 bp, Homo sapiens
  Payload ID: 17055
  Gene Symbol: SYNRG
  Gene Name: synergin, gamma
  Uniprot ID: Q9UMZ2
  ENST ID: ENST00000622045
  CDS Start-End: 27-3806
gaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacatgctgctgggaaaagatgactgtgattacaaagcatctctctccttaccatgagctcttagaagaaaagccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggt

SEQ ID NO: 188309 - DNA, 3859 bp, Homo sapiens; identical to SEQ ID NO: 188308
  Payload ID: 17055
  Gene Symbol: SYNRG
  Gene Name: synergin, gamma
  Uniprot ID: Q9UMZ2
  ENST ID: ENST00000613407
  CDS Start-End: 27-3806

SEQ ID NO: 188310 - DNA, 8229 bp, Homo sapiens; identical to SEQ ID NO: 188302
  Payload ID: 17055
  Gene Symbol: SYNRG
  Gene Name: synergin, gamma
  Uniprot ID: Q9UMZ2
  ENST ID: ENST00000612223
  CDS Start-End: 142-4086

SEQ ID NO: 188311 - DNA, 4841 bp, Homo sapiens; identical to SEQ ID NO: 188304
  Payload ID: 17055
  Gene Symbol: SYNRG
  Gene Name: synergin, gamma
  Uniprot ID: Q9UMZ2
  ENST ID: ENST00000621136
  CDS Start-End: 57-3731

SEQ ID NO: 188312 - DNA, 4050 bp, Homo sapiens; identical to SEQ ID NO: 188307
  Payload ID: 17055
  Gene Symbol: SYNRG
  Gene Name: synergin, gamma
  Uniprot ID: Q9UMZ2
  ENST ID: ENST00000632841
  CDS Start-End: 32-3571

SEQ ID NO: 188313 - DNA, 485 bp, Homo sapiens; identical to SEQ ID NO: 188305
  Payload ID: 17055
  Gene Symbol: SYNRG
  Gene Name: synergin, gamma
  ENST ID: ENST00000632310
  CDS Start-End: 110-485

SEQ ID NO: 188314 - DNA, 3787 bp, Homo sapiens; identical to SEQ ID NO: 188299
  Payload ID: 17055
  Gene Symbol: SYNRG
  Gene Name: synergin, gamma
  Uniprot ID: Q9UMZ2
  ENST ID: ENST00000633429
  CDS Start-End: 27-3734

SEQ ID NO: 188315 - DNA, 527 bp, Homo sapiens
  Payload ID: 17055
  Gene Symbol: SYNRG
  Gene Name: synergin, gamma
  ENST ID: ENST00000633203
  CDS Start-End: 1-323
agcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggtagttttaagaggcattatatttttcttttctgggaaggtgatttatgtagtccctgtttctttacctcgccattatatgtgtgtgtgaaaagtcaatgtagaactcttccttcaagctaagtacagatttggatgttctcaaatatacagtggcttaagagctctggtctggataacaactgtcttgggaggaaaaaacctctttgtcttctaagtaaatatcagtatgacaatttcacctgtaagttttctgtatataaatatgttaacattagtaaaatctattcactcagagcaaatgtaataaaggagtttaccatttaa

SEQ ID NO: 188316 - DNA, 656 bp, Homo sapiens
  Payload ID: 17056
  Gene Symbol: SYNJ2BP-COX16
  Gene Name: SYNJ2BP-COX16 readthrough
  ENST ID: ENST00000618385
  CDS Start-End: 22-144
aagccagacgagctgtaaaacatgaacggaagagtggattatttggtcactgaggaagagatcaatcttaccagagggccctcaggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatggtagcagcctgggctttcatgagataccggcaacaactttgaaaaacttgctctctttcaatactcccaatgaagatacatttcactcaccctccacccctgctattctgccatgtctttccctctctctgcatagccagatttgaagtgactgatacccaccccaaaccttgctgttcacagtctccaattcttcatattctaatgggaaagtaaagcggaaaccattcactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgttt

SEQ ID NO: 188317 - DNA, 580 bp, Homo sapiens
  Payload ID: 17056
  Gene Symbol: SYNJ2BP-COX16
  Gene Name: SYNJ2BP-COX16 readthrough
  ENST ID: ENST00000617196
  CDS Start-End: 22-580
aagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttacaggtgcagaatggacctataggacatcgaggtgaaggggacccaagtggtattcccatatttatggtgctggtgccagtgtttgccctcaccatgatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagcctta

SEQ ID NO: 188318 - DNA, 318 bp, Homo sapiens
  Payload ID: 17056
  Gene Symbol: SYNJ2BP-COX16
  Gene Name: SYNJ2BP-COX16 readthrough
  ENST ID: ENST00000555276
  CDS Start-End: 158-318
aagccagacgagctgtaaaacatgaacggaagagtggattatttggtcactgaggaagagatcaatcttaccagagggccctcagttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagcct

SEQ ID NO: 188319 - DNA, 929 bp, Homo sapiens
  Payload ID: 17056
  Gene Symbol: SYNJ2BP-COX16
  Gene Name: SYNJ2BP-COX16 readthrough
  ENST ID: ENST00000621525
  CDS Start-End: 112-660
ggctgctgaaaccgaaaccgctgtgctgtgggcgcagcgccgagattgattcaccttcacctgtgctgcactccagctgacccaagtaggaagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggttgctgattgttggaggttcttttggtcttcgtgagttttctcaaatccgatatgatgctgtgaagagtaaaatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagccttaagactaagacaacttgactctgctgattcttttttccttttttttttttttaaataaaaatattattaactggacttcctaatatatacttctatcaagtggaaaggaaattccaggcccatggaaacttggatatgggtaatttgatgacaaataatcttcactaaaggtcatgtacaggtttttatacttcccagctattccatctgtggatgaaagtaacaatgttggccacgtatattttacacctcgaaataaaaaatgtgaatactgctccaaaaacaga

SEQ ID NO: 188320 - DNA, 479 bp, Homo sapiens
  Payload ID: 17056
  Gene Symbol: SYNJ2BP-COX16
  Gene Name: SYNJ2BP-COX16 readthrough
  ENST ID: ENST00000617124
  CDS Start-End: 22-479
aagccagacgagctgtaaaacatgaacggaagagtggattatttggtcactgaggaagagatcaatcttaccagagggccctcagggctgggcttcaacatcgtcggtgggacagatcagcagtatgtctccaacgacagtggcatctacgtcagccgcatcaaagaaaatggggctgcggccctggatgggcggctccaggagggtgataagatcctttcggtaaatggccaagacctaaagaacctgctgcaccaggatgctgtagacctctttcgtaatgcaggctatgctgtgtctctgagagtgcagcacaggatggatcctgagcttgaaaaaaaactgaaagagaataaaatatctttagagtcggaatatgagaaaatcaaagactccaagtttgatgactggaagaatattcgaggacccaggccttgggaagatcctgacctcctccaaggaagaaatccagaaagcct

SEQ ID NO: 188321 - DNA, 3048 bp, Homo sapiens
  Payload ID: 17057
  Gene Symbol: SYVN1
  Gene Name: synovial apoptosis inhibitor 1, synoviolin
  Uniprot ID: Q86TM6
  ENST ID: ENST00000294256
  CDS Start-End: 95-1945
gggggtggggagtgttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaa

SEQ ID NO: 188322 - DNA, 2841 bp, Homo sapiens
  Payload ID: 17057
  Gene Symbol: SYVN1
  Gene Name: synovial apoptosis inhibitor 1, synoviolin
  Uniprot ID: Q86TM6
  ENST ID: ENST00000307289
  CDS Start-End: 43-1740
gcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggacttttatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaac

SEQ ID NO: 188323 - DNA, 3052 bp, Homo sapiens
  Payload ID: 17057
  Gene Symbol: SYVN1
  Gene Name: synovial apoptosis inhibitor 1, synoviolin
  Uniprot ID: Q86TM6
  ENST ID: ENST00000377190
  CDS Start-End: 96-1949
agggggtggggagtgttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaa

SEQ ID NO: 188324 - DNA, 826 bp, Homo sapiens
  Payload ID: 17057
  Gene Symbol: SYVN1
  Gene Name: synovial apoptosis inhibitor 1, synoviolin
  ENST ID: ENST00000531018
  CDS Start-End: 117-826
tgcatgatgagtcccaaggagaggaaagcagaaagtgacctcaaaccacagcctctccccactcctaggtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaaga

SEQ ID NO: 188325 - DNA, 775 bp, Homo sapiens
  Payload ID: 17057
  Gene Symbol: SYVN1
  Gene Name: synovial apoptosis inhibitor 1, synoviolin
  ENST ID: ENST00000528487
  CDS Start-End: 63-775
gccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgag

SEQ ID NO: 188326 - DNA, 709 bp, Homo sapiens
  Payload ID: 17057
  Gene Symbol: SYVN1
  Gene Name: synovial apoptosis inhibitor 1, synoviolin
  ENST ID: ENST00000532771
  CDS Start-End: 1-448
ggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtcttatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaa

SEQ ID NO: 188327 - DNA, 796 bp, Homo sapiens
  Payload ID: 17057
  Gene Symbol: SYVN1
  Gene Name: synovial apoptosis inhibitor 1, synoviolin
  ENST ID: ENST00000527142
  CDS Start-End: 16-465
ctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccct

SEQ ID NO: 188328 - DNA, 3144 bp, Homo sapiens
  Payload ID: 17057
  Gene Symbol: SYVN1
  Gene Name: synovial apoptosis inhibitor 1, synoviolin
  Uniprot ID: Q86TM6
  ENST ID: ENST00000526060
  CDS Start-End: 194-2044
ttgtggttggggtcgggacccgaaccttccccttgaggtctccggagtcggcacgcccctcagccccgccgcacgctttcggcctgtcagctggccggagacctcagacgccggtgcggccgctttgctcaagcctgggccctgcctgcgacgcccgcaactcctggtgctcacaggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcctctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaa

SEQ ID NO: 188329 - DNA, 4493 bp, Homo sapiens
  Payload ID: 17058
  Gene Symbol: SS18L1
  Gene Name: synovial sarcoma translocation gene on chromosome 18-like 1
  Uniprot ID: O75177
  ENST ID: ENST00000331758
  CDS Start-End: 27-1217
cacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatc

SEQ ID NO: 188330 - DNA, 1238 bp, Homo sapiens
  Payload ID: 17058
  Gene Symbol: SS18L1
  Gene Name: synovial sarcoma translocation gene on chromosome 18-like 1
  Uniprot ID: O75177
  ENST ID: ENST00000370848
  CDS Start-End: 34-978
acttcctgttgcctgcagccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatat

SEQ ID NO: 188331 - DNA, 781 bp, Homo sapiens
  Payload ID: 17058
  Gene Symbol: SS18L1
  Gene Name: synovial sarcoma translocation gene on chromosome 18-like 1
  ENST ID: ENST00000450482
  CDS Start-End: 397-781
cacgggctgagccccgcgccgccaccatgtccgtggccttcgcgtctgcccggccaagaggcaaaggggaggttacgcagcaaaccatccagaagtttttgaagaatgccggccagtcatcgagtgcccttggtttgggtacaaggtgcgttttcctaacttgcgggtctgaaagtgcgtccattcccccttcacgcctggttgcggtttcggcggactagaatttctacgcagaagtctccctcaggatcagaccgtagcccttccggaaacctccatgatgctggacgagaaccaccacctgatccagtgcatcctggagtaccagagcaagggcaagacggccgagtgcacgcagtgagtgcccgccatacaccggaacacttggagggtgtcatgcagagtctaagcacagaggccagatacgtcccaagagtcccccagcacagagatcagataagtcccaggagtccccagcacggaggccagatatgtcccaggagtcccctgcacagaggccagatatgtcccaggagtcccccagcacggaggtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacg

SEQ ID NO: 188332 - DNA, 899 bp, Homo sapiens
  Payload ID: 17058
  Gene Symbol: SS18L1
  Gene Name: synovial sarcoma translocation gene on chromosome 18-like 1
  ENST ID: ENST00000492466
  CDS Start-End: 1-635
tctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggacctacttgctcagatctccaagcaagcatttcttttcttttagggatgtctgaaagtcacatccagttacattactgtgttctttctaatgaaaagtaaaggttttatatagag

SEQ ID NO: 188333 - DNA, 815 bp, Homo sapiens
  Payload ID: 17059
  Gene Symbol: SS18L2
  Gene Name: synovial sarcoma translocation gene on chromosome 18-like 2
  Uniprot ID: Q9UHA2
  ENST ID: ENST00000011691
  CDS Start-End: 93-326
taggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaatact

SEQ ID NO: 188334 - DNA, 1047 bp, Homo sapiens
  Payload ID: 17059
  Gene Symbol: SS18L2
  Gene Name: synovial sarcoma translocation gene on chromosome 18-like 2
  Uniprot ID: Q9UHA2
  ENST ID: ENST00000447630
  CDS Start-End: 209-442
cctcacctcgcccggacggcggccttcggaagtcggcgcctgccagctacccgccgcctcctcagcaatcttagccgaccgggagggctcggcccaggtcaccggcagcccaggcgcaggcgggagcatccaatcaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgaggagtaattgaatgtaatccatctcttacaaaatggagacagggtctttaccaactcaactggttaaaacatgaatgaaacctctgtggctctttcgaaacgtgaaaatgtgaagaaagctactaacttagctgtattctcatgtaaatattttttaaataattaagcaaatccctcaataagttgagcccaggtgtcctctttcctgaacttggagcatgtttggataacaaagacatcactgggatgttcaagtctactttttagtttcaacctgaagaggaaactcagtaggtgttgggcaggaattggtgagattcctgacttgataccttgctaaatggacatgtaactgtgtgctccttcctatcagtttgtaaatgtggtccccctgactgctgttttcagattgctttgaaataaagcttatttttctataaaatactgatgtggaggtatagaagttttcatgtaataagtattccatttggttttcaagaataactgtgaggacttaaccataaagtatataaaaacaatactattatcattgccaacaaaa

SEQ ID NO: 188335 - DNA, 1836 bp, Homo sapiens
  Payload ID: 17060
  Gene Symbol: SS18
  Gene Name: synovial sarcoma translocation, chromosome 18
  Uniprot ID: Q15532
  ENST ID: ENST00000269137
  CDS Start-End: 333-1496
tttcctgaatcgctgaagcggagggaggactagggcgcgactctaccattagcgcaaagggccagggggtgcccataaggagagctcgggggatgcagggacggtcaagaaagttcggccagggctaggggtcccccagagtgcgcagaagcgagacatccctggccagagtgcctccttcaggcctgccccgccgcccgtccgcttggccccggagcatcccccctccccgcattcccgaggtggttcagcccgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaag

SEQ ID NO: 188336 - DNA, 1548 bp, Homo sapiens
  Payload ID: 17060
  Gene Symbol: SS18
  Gene Name: synovial sarcoma translocation, chromosome 18
  ENST ID: ENST00000269138
  CDS Start-End: 30-215
gacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaattt

SEQ ID NO: 188337 - DNA, 3414 bp, Homo sapiens
  Payload ID: 17060
  Gene Symbol: SS18
  Gene Name: synovial sarcoma translocation, chromosome 18
  Uniprot ID: Q15532
  ENST ID: ENST00000415083
  CDS Start-End: 57-1313
agtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaa

SEQ ID NO: 188338 - DNA, 2321 bp, Homo sapiens
  Payload ID: 17060
  Gene Symbol: SS18
  Gene Name: synovial sarcoma translocation, chromosome 18
  ENST ID: ENST00000542420
  CDS Start-End: 123-1310
ccttccacctctgccctatctcggcagatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttca

SEQ ID NO: 188339 - DNA, 977 bp, Homo sapiens
  Payload ID: 17060
  Gene Symbol: SS18
  Gene Name: synovial sarcoma translocation, chromosome 18
  ENST ID: ENST00000539244
  CDS Start-End: 45-170
acccggagcgctcgggacttgccgatagtggtgacggcggcaacatgtctgtggctttcgcggccccgaggcagcgaggcaagggggagatcactcccgctgcgattcagaaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcatacca

SEQ ID NO: 188340 - DNA, 545 bp, Homo sapiens
  Payload ID: 17060
  Gene Symbol: SS18
  Gene Name: synovial sarcoma translocation, chromosome 18
  ENST ID: ENST00000580642
  CDS Start-End: 57-233
agtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctagggtcatgaataaaccacatctgttagtatggtttggtcagtggtcctcagaaaatctcatgtcgtgcaaccatactaatactcaagcaaaggaaaacttgaaggcctagactgaaacaggtatcagcagatgttgcacacaaacttggtataccttgctacaatagcagattctaat

SEQ ID NO: 188341 - DNA, 1840 bp, Homo sapiens
  Payload ID: 17060
  Gene Symbol: SS18
  Gene Name: synovial sarcoma translocation, chromosome 18
  ENST ID: ENST00000579640
  CDS Start-End: 42-218
cggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcact

SEQ ID NO: 188342 - DNA, 646 bp, Homo sapiens
  Payload ID: 17060
  Gene Symbol: SS18
  Gene Name: synovial sarcoma translocation, chromosome 18
  ENST ID: ENST00000579061
  CDS Start-End: 190-646
agatgctccacggatttgcacgaactcccgagtcttgacctccctcccctctccgggctgccgggacaactcggggcggccactcttgccaggaggcgtaagtaaggatgaagttggaaaaactgaactaggtctagggcacgctctgcaacacagtcggggagacgcttcagagggccggagagggagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtac

SEQ ID NO: 188343 - DNA, 1545 bp, Homo sapiens
  Payload ID: 17060
  Gene Symbol: SS18
  Gene Name: synovial sarcoma translocation, chromosome 18
  ENST ID: ENST00000585121
  CDS Start-End: 29-283
acttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaggtcatgaataaaccacatctgttagtatggtttggtcagtggtcctcagaaaatctcatgtcgtgcaaccatactaatactcaagcaaaggaaaacttgaaggcctagactgaaacaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacag

SEQ ID NO: 188344 - DNA, 588 bp, Homo sapiens
  Payload ID: 17060
  Gene Symbol: SS18
  Gene Name: synovial sarcoma translocation, chromosome 18
  ENST ID: ENST00000581021
  CDS Start-End: 379-588
actttggcgtcgccccgccccgcgtgccgcggctgcttcgtgcggaccccaccgcgggtcgcggcaggcagaggggaagtcggtgcgctggtcgccgccctgcaaactcagccgagtttgggagctcgcaggaggacttggggaacgctggagggaaccttagtatagagtttgaggagcgggcaaggaaggtccccatggactctggggttgtccccagagcctcttcttcccttctgcatcgccgcctattcatttattctgcagcaaatatttattgagcgcctattttaggcgctgaggctactgtggtgagtcatggtccttgccttcctggagcttacagtctaatggtggagactgtcgtgaccagttaatatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagc

SEQ ID NO: 188345 - DNA, 510 bp, Homo sapiens
  Payload ID: 17060
  Gene Symbol: SS18
  Gene Name: synovial sarcoma translocation, chromosome 18
  ENST ID: ENST00000577572
  CDS Start-End: 57-263
agtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcattggagattgcctattcattgccttctctatatgctgtgtcctgatagatgggtagtataaacacagtgggcctaagttgttggtcattgctacagtagtgaaaaggaaaaaaaggtatcagcagatgttgcacacaaacttggtataccttgctacaatagcagattctaatcaaaatatgcagtctcttttaccagcagtgtgattcaagtaaggtgaaggaacacatgcttagagctgtggaacattttgaagattagcagccacccacacagaatatgcctatgggtcctggagggatgaatca

SEQ ID NO: 188346 - DNA, 531 bp, Homo sapiens
  Payload ID: 17060
  Gene Symbol: SS18
  Gene Name: synovial sarcoma translocation, chromosome 18
  ENST ID: ENST00000582792
  CDS Start-End: 29-313
acttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcatacaaaaattggctggacgtggtggtggatacctgtaatcccaactgcttgggaggctgaggcaggagaatcacttgaacctgggaggcggagattacaagtgagccaagatcgcaccactgcactccagcctagctgacagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaa

SEQ ID NO: 188347 - DNA, 580 bp, Homo sapiens
  Payload ID: 17060
  Gene Symbol: SS18
  Gene Name: synovial sarcoma translocation, chromosome 18
  ENST ID: ENST00000577636
  CDS Start-End: 98-265
agatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcagtgtgattcaagtaaggtgaaggaacacatgcttagagctgtggaacattttgaagattagcagccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggtta

SEQ ID NO: 188348 - DNA, 663 bp, Homo sapiens
  Payload ID: 17060
  Gene Symbol: SS18
  Gene Name: synovial sarcoma translocation, chromosome 18
  ENST ID: ENST00000584083
  CDS Start-End: 273-663
gtgcggaccccaccgcgggtcgcggcaggcagaggggaagtcggtgcgctggtcgccgccctgcaaactcagccgagtttgggagctcgcaggaggacttggggaacgctggagggaaccttagtatagagtttgaggagcgggcaaggaaggtccccatggactctggggttgtccccagagcctcttcttcccttctgcatcgccgcctattcatttattctgcagcaaatatttattgagcgcctattttaggcgctgaggctactgtgatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgcctt

SEQ ID NO: 188349 - DNA, 547 bp, Homo sapiens
  Payload ID: 17060
  Gene Symbol: SS18
  Gene Name: synovial sarcoma translocation, chromosome 18
  ENST ID: ENST00000580751
  CDS Start-End: 57-239
agtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaatctggccagtgggagcccctcaagctggcttcttgatatgtcttcattattttttgaacatttacttattttcttataccacaaaatgttctaggctcatcctggtttttttttcctgtgcagcatatctctttttttctgtagttggagattgcctattcattgccttctctatatgctgtgtcctgatagatgggtagtataaacacagtgggcctaagttgttggtcattgctacagtagtgaaaaggaaaaaaaggtatcagcagatgttgcacacaaacttggtataccttgctacaatagcagattctaatcaaaatatgcagtctcttttaccagca

SEQ ID NO: 188350 - DNA, 571 bp, Homo sapiens
  Payload ID: 17060
  Gene Symbol: SS18
  Gene Name: synovial sarcoma translocation, chromosome 18
  ENST ID: ENST00000581570
  CDS Start-End: 40-222
gagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaatctggccagtgggagcccctcaagctggcttcttgatatgtcttcattattttttgaacatttacttattttcttataccacaaaatgttctaggctcatcctggtttttttttcctgtgcagggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtatcagcagatgttgcacacaaacttggtataccttgctacaatagcagattctaatcaaaatatgcagtctcttttaccagcaccacccacaca

SEQ ID NO: 188351 - DNA, 585 bp, Homo sapiens
  Payload ID: 17060
  Gene Symbol: SS18
  Gene Name: synovial sarcoma translocation, chromosome 18
  ENST ID: ENST00000582448
  CDS Start-End: 98-205
agatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcaggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctagcatatctctttttttctgtagttggagattgcctattcattgccttctctatatgctgtgtcctgatagatgggtagtataaacacagtgggcctaagttgttggtcattgctacagtagtgaaaaggaaaaaaaggtatcagcagatgttgcacacaaacttggtataccttgctacaatagcagattctaatcaaaatatgcagtctcttttaccagcaccacccacacagaatatgcctatg

SEQ ID NO: 188352 - DNA, 756 bp, Homo sapiens
  Payload ID: 17060
  Gene Symbol: SS18
  Gene Name: synovial sarcoma translocation, chromosome 18
  ENST ID: ENST00000578954
  CDS Start-End: 84-266
agcccgagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcaatctggccagtgggagcccctcaagctggcttcttgatatgtcttcattattttttgaacatttacttattttcttataccacaaaatgttctaggctcatcctggtttttttttcctgtgcaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcag

SEQ ID NO: 188353 - DNA, 575 bp, Homo sapiens
  Payload ID: 17060
  Gene Symbol: SS18
  Gene Name: synovial sarcoma translocation, chromosome 18
  ENST ID: ENST00000578700
  CDS Start-End: 122-259
cttccacctctgccctatctcggcagatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcattggagattgcctattcattgccttctctatatgctgtgtcctgatagatgggtagtataaacacagtgggcctaagttgttggtcattgctacagtagtgaaaaggaaaaaaaggtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcag

SEQ ID NO: 188354 - DNA, 1298 bp, Homo sapiens
  Payload ID: 17061
  Gene Symbol: SSX1
  Gene Name: synovial sarcoma, X breakpoint 1
  Uniprot ID: Q16384
  ENST ID: ENST00000376919
  CDS Start-End: 137-703
tcctggagcaatgacattgcagaatattttctcctcctccagccacactttgtcaccaactgctgccaactcgccaccactgctgccgacctcgcaaccactgctttgtctctgaagtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagtgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttc

SEQ ID NO: 188355 - DNA, 1292 bp, Homo sapiens
  Payload ID: 17062
  Gene Symbol: SSX2
  Gene Name: synovial sarcoma, X breakpoint 2
  Uniprot ID: Q16385
  ENST ID: ENST00000337502
  CDS Start-End: 99-665
actttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 188356 - DNA, 1410 bp, Homo sapiens
  Payload ID: 17062
  Gene Symbol: SSX2
  Gene Name: synovial sarcoma, X breakpoint 2
  Uniprot ID: Q16385
  ENST ID: ENST00000336777
  CDS Start-End: 71-742
ctcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttc

SEQ ID NO: 188357 - DNA, 764 bp, Homo sapiens
  Payload ID: 17062
  Gene Symbol: SSX2
  Gene Name: synovial sarcoma, X breakpoint 2
  ENST ID: ENST00000610779
  CDS Start-End: 90-656
tcactgacttctccctccacaggatcaaagctgctgtggctggaaagactcaggctatttctcttgcaggtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcgaagggagtgccagaagcatctggctcacagaacgatgggaaacacctgtgccctccaggaaaaccaagtacctctgagaagattaacaagacatccggacccaaaagggggaaacatgcctggacccacagactgcgtgagagaaagcagctggtgatttatgaagagatcagcgaccctgaagaagacgacgagtaactcccctcggggatacgacatatgcccatgatgagaagcagaacgtggtgacctttcacgaacatgggcatggctgcggacccctcgtcatcaggtgcatagcaagtg

SEQ ID NO: 188358 - DNA, 5835 bp, Homo sapiens
  Payload ID: 17063
  Gene Symbol: SSX2IP
  Gene Name: synovial sarcoma, X breakpoint 2 interacting protein
  Uniprot ID: Q9Y2D8
  ENST ID: ENST00000342203
  CDS Start-End: 265-2109
cctcggaaacctgcggaggccgggaggcggctgcaaggggcggggaaggcgggagcccgcagcggaggaggggccgcgggcgggaggcgctgcgaggcgctgctggccctcgggctgcgggagccgggctaggacgccgagcggtgactccccgccgctcccgggggccgtgacggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagaggtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacac

SEQ ID NO: 188359 - DNA, 5843 bp, Homo sapiens
  Payload ID: 17063
  Gene Symbol: SSX2IP
  Gene Name: synovial sarcoma, X breakpoint 2 interacting protein
  Uniprot ID: Q9Y2D8
  ENST ID: ENST00000437941
  CDS Start-End: 354-2117
gggcgggaggcgctgcgaggcgctgctggccctcgggctgcgggagccgggctaggacgccgagcggtgactccccgccgctcccgggggccgtgacggtgagcagcagcgcctcgcgtcggggattgtgacgcgccccgccagggaggggcgggcgggggtgggcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataacttaagatggtctgagttgtttgtttggacttccctgtcttcccccaaagagttgaaatcttaaatctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggcattggaagtttagcctttacttgaatgtatactgtagatttttaacaaagcgagttctatatttattatgtttagtgtggtttgaaattacctctttcatatgttttaaataaagtgaaatttatgtatgttttgtacatagatacacatgattatgttaagaggctttaagatttaaaagtttcacacaaccataagtatagtatttcatgccagtaaaatttttttagtggtattctgtttacagatgtattaggaccattgatgcattacatttaagaattctctttaatacatctgggcaataaatattgaaaggtattccatgaagctgagttctttagataatcaacactactaacattacatttttgagatttttatgacattagatttttattttgtatatgtagaatattataatttttaaaaggactattgatgatagaagaataggggcaagacgacaaaagtacctttgaataaaacaatttaagaaattggtttaagatattggatgatagaagatatttaagatatctagatggtgatattttccttacaagatgggtaccagtatagtaatatctgtatactaactagggctttgtattgtcaataattttttaataattttttaatgaggtatttaccactgaagaaatatgataatataaaaccatcaaattttataattgagatgatactctggaaaaacatgtcatttcattttcagaaaactcttaagctctcttcagtctctgtaatgtttctgattgcatgtttcttcatgaaaagtatgttgttgttttgatagtaataataataaatgtaggctcagctctttcccaggattttcatcaaaaagctttaagtgcctaaccctgcttgtctctgtacatagaagcctgcacagatccaacccttgctaggtatcatagtttaggcccatttaccttcccctgtactggcagttcagccgcttacatgcactcaccctgtttgtggctattttaaattcatattattaaaaaacaaaaaaaacccacctatttgtgttgtccattcactatacgtaactatgtaactctttggagttgcatagcagcagccattttttcagggctgataggatatcattaagagtgtcttatgagacattagtggatatactcatagtaaccatatttatagttttaaagagctagctcttgagcattagtcactaccttcagcttgatgcatggtcacttctttactatttaaaatactacacattgtacaaaatatcgaagacactaccatatgctaaaggaagaaatctagctgggatataggatttttgttgtttttgtttttgtttgttttgctatttagcaataacatggtcaaaaaggcaatcagaaattttaaatacagttaatggatacatttggcaacaattttcccccgagggttttccatggtgtactttgcaagaaataagcactctaatttttaaagtaaatctcttattttagcaaatattatatttcatgacaatggagttctagaaagcagcatctgttttttgttgcgtgtttccattttaaagtgagttgagttctcaaattggaaagaaagattccttgagacgtacttttaaaatctaaagtgtgaaagaaacagcagagtaaaagccagactcattgcaccttcaatgtctgcatagatccagaagttgtacattttacctaacaacatcacttttgttgaacattccaactccagaatgatccccaatcaccctaatctcagaatgctggaatgatgtctgttggaaaacccaggactccacacacaaaactcctgggattttgtttcccatctctttctaggtgtttgcaatgtacaaataatacagctgtgctaatctcacatttagccatgatagatgatggttctagagtgtacttccatttgtaagtcctcctgataagtgctttcttgtttatcactatgtaaatctgaaatattttgtacttcatttgtttttatccattctgaattttcaaagcataaaaatgtcaaagaaaaattgagataaacattttgttcaccattaaatgtttgcatctgcagtctatgatgagaaacaatgaaattatgactaaaatttaacaaatagtattttcttatagaagcaatgtattaaatgattagatacacaggacagttcacagcaaattgtttacttacatggcataattgaaatactgttatttgtaaagagttctatactgcctaccttagctaaccagaattgttcatagacttgtgataatatggtgttatgggaaaacacattttgtgcgcatgatgaagagagcaccgtgaatctagtcttgactgcccctggtggaacatttgaaagcccttgggactccaggagagaggtttttgcagcatgtatgctaaatttgtgagttagcaagaccctgctgtgattactatgttgtacagatcttcaaagtatattgcctaatatgagtcatgttatttctagattgaatttaaagtaagtatggattatggaagtctagtaaatatacttttccctatttttgtcctttttcagtcttttggtaagcatttattaagtacctgctgtatgtcaaggcttactactgctttccaatccttggtgatatgaagacagataagcacgctgcctgctattaggaatctgagctgagtggaaggccaactattaaacctacattgtaataaacaatggtggatgctacggacacattcagtctgttcataaaacatggactgatgggtctgctccaggccacatttgttttttaacagtaacgtggctaggcttccatttataagtcttagcattatttcctttgtgaagtactatgtaacagatgattgtttgctagattttgttttctacaatcaaaatgttgacctgcaaagcagtgtaggattttctctcctcaagagcgtgtattattatctagtagaaaaagcattcccaaagacttggtccatgcagataaggataatgaaattgctcactctaatcctttttctaaatacagtgtttttcaagctggatgtaaattagagtgggtggatattgattaaattatttgatttatatgaaatcaaatgactggttgaggtttttttgaacatttacaaataatggattcctgagagctcaggaagtactgtaatgtcagtgacatatgaagctcctgataaagatccacctcattcatatatttgagcttcagaaatacatgtacctagtataatgcttaacagcacataatatttgttgatgagaaatacactgatgaaacaacac

SEQ ID NO: 188360 - DNA, 759 bp, Homo sapiens
  Payload ID: 17063
  Gene Symbol: SSX2IP
  Gene Name: synovial sarcoma, X breakpoint 2 interacting protein
  ENST ID: ENST00000422026
  CDS Start-End: 220-759
agaagggggcggggagcagaaaacggccgggtgaatcactgggcgtaacaggtgccgcagccgcagctgcgcccgcagcgcgcgcggaccgcagggataaggtcttctttttctccgggtttttttggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtg

SEQ ID NO: 188361 - DNA, 2457 bp, Homo sapiens
  Payload ID: 17063
  Gene Symbol: SSX2IP
  Gene Name: synovial sarcoma, X breakpoint 2 interacting protein
  Uniprot ID: Q9Y2D8
  ENST ID: ENST00000481102
  CDS Start-End: 241-1923
gcgccggcaaggggcgggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggaggagatgcctacatagaagagtgacagcagctagactaaatgtttaactgctgaactagttcctcaggtatcctggctctagagattgctatgggagattggatgactgttacagatccaggtctgtcttcagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagggcaaagaactgagaaaagcctgttcctgttgagtgaaaaagatttgtgcccaaggatgacagtgtaaaaaaacatggctctccaccctgggaaacccatatgttgctcttaattgctacattttggtgttttcctgtatctcaagttattatatcattttctaagataagatcaatactctgcttcagtgccaattccaagattagttttaaacgaagaagaggaagcaggtagaacattcctagtaagacagagaggaatagaaaagatcagagggttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaataa

SEQ ID NO: 188362 - DNA, 1149 bp, Homo sapiens
  Payload ID: 17063
  Gene Symbol: SSX2IP
  Gene Name: synovial sarcoma, X breakpoint 2 interacting protein
  ENST ID: ENST00000603677
  CDS Start-End: 191-454
gggcgcgcgcggaggtgagagccggcacctggctcagcgccccgttgttcggcgggaggctccgcgcggctgttggggccgttgcagggtgcgggcgagcgtcgacccgggccgctcctggaggaggaggtgggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacataggtatttgtctataggtgatcttttcacgtgtttctaaaaattgctaaagttgcactgctaagggaaaggtggcatgtctgtagtattagcaacaatagagattttggagaggaatttagtagatgatttattcattctacaaatattgagtgtccagtatatatagacactgtgctagatgctggaaatacactagtgaacaggtagatctgttgtcttcttggaggtaaatcatatgatgtgtgtctttttatttcacatttaagatacaatttagaatgtagtcttaattataggagttaatattttaagcactttaattgtattaaatggaaggatattgttttgacagtttttgtagagtacatatcttaacacttttttccggcatgcccattttattgttgttgaagggcaaagaactgagaaaagcctgttcctgttgagtgaaaaagatttgtgcccaaggatgacagtgtaaaaaaacatggctctccaccctgggaaacccatatgttgctcttaattgctacattttggtgttttcctgtatctcaagttattatatcattttctaagataagatcaatactctgcttcagtgccaattccaagattagttttaaacgaagaagaggaagcaggtagaacattcctagtaagacagagaggaatagaaaagatcagaggggtaagttggaaagtatggtggtaatctctttgctcttaatt

SEQ ID NO: 188363 - DNA, 1933 bp, Homo sapiens
  Payload ID: 17063
  Gene Symbol: SSX2IP
  Gene Name: synovial sarcoma, X breakpoint 2 interacting protein
  Uniprot ID: Q9Y2D8
  ENST ID: ENST00000605755
  CDS Start-End: 113-1876
gctggccctcgggctgcgggagccgggctaggacgccgagcggtgactccccgccgctcccgggggccgtgacgaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttg

SEQ ID NO: 188364 - DNA, 2272 bp, Homo sapiens
  Payload ID: 17063
  Gene Symbol: SSX2IP
  Gene Name: synovial sarcoma, X breakpoint 2 interacting protein
  ENST ID: ENST00000476905
  CDS Start-End: 224-1738
aacaggtgccgcagccgcagctgcgcccgcagcgcgcgcggaccgcagggataaggtcttctttttctccgggtttttttggagatgaggaaagtgaggcccaaagaagatttatgttcaggaccatttagtctgagatgcctacatagaagagtgacagcagctagactaaatgtttaactgctgaactagttcctcaggtatcctggctctagagattgctatgggagattggatgactgttacagatccagaaagcaaaactatctctcaatatacctcagaaacaaagatgtctccatcaagtttatactcacagcaagtgctatgttcttcaatacctttatcgaaaaatgtgcacagttttttcagtgccttctgcacagaagataatattgaacagagtatctcatatcttgatcaggaattgactacttttggttttccttcattatatgaagaatccaaaggtaaagagacaaagagagagttaaatatagtagctgtactaaattgtatgaatgagctgcttgtgcttcagcggaagaaccttctagctcaggaaaatgtggagacacagaatttgaagctgggaagtgatatggaccatctacagagctgctactcaaaacttaaggaacaactggaaacctccaggagggaaatgattgggcttcaggaaagagacagacagttacaatgtaagaacaggaatttgcatcagctactaaagaatgagaaagatgaggtgcaaaaattacaaaatatcattgcaagtcgagctactcagtataatcatgatatgaagagaaaagagcgtgaatataataaactgaaggaacgtctacatcaacttgttatgaacaagaaagataagaaaatagctatggacattttgaattatgtcgggagagctgatggaaaaagaggctcctggaggactggtaaaactgaagccaggaatgaagatgaaatgtataaaattctcttgaatgattatgaatatcgtcagaaacaaatcctaatggaaaatgcagaacttaagaaggttcttcaacaaatgaaaaaggaaatgatttctcttctttctccccaaaagaagaaacctagagaaagagtagatgatagtacaggaactgttatttccgatgttgaagaagatgccggggaactaagcagagagagtatgtgggacctttcctgtgaaactgtgagagagcagcttacaaacagcatcagaaaacagtggagaattttgaaaagtcatgtagaaaagcttgataaccaagtttcaaaggtacacctggaaggttttaatgatgaagatgtaatctcacgacaagaccatgaacaagaaactgaaaaactcgagttagaaattcagcagtgtaaagaaatgattaaaactcagcaacagcttttacagcagcagctcgctactgcatatgatgatgataccacttcactattacgagactgttatttgttggaagaaaaggaacgtctcaaagaagaatggtccctttttaaagagcagaaaaagaattttgagagggagagacgaagctttacagaagccgctattcgcctgggattggagattggctttctcctgctaagtgttttacacaagaaatctcttttgggtatccatcattcatccacggtcagtaggtgtggtgtcagaagacagtgcaaccaagactatatttgctgtttaaaaaagaaaggcatttgaagaagaaagagccagttggttaaagcagcagtttctaaatatgactacctttgaccaccagaactcagaaaatgtgaaacttttcagtgccttctcaggaagttctgattgggacaatcttatagtgcactcgaggcagccgcaaaagaagcctcacagtgtgtctaatgggtctccagtttgcatgtctaaacttactaaatctcttcctgcttcaccttccacttcagacttttgccagacacgttcctgcatatctgaacatagttcaatcaatgtactgaatataactgctgaagaaattaaaccaaatcaggttggaggagaatgtacaaatcaaaaatggagtgtggcatcaagacctggatcacaggaaggttgctatagtggatgctccttgagctacacaaattctcatgtagaaaaagatgacttaccttagacatgtggactggaatttttttcattaatgtgttcatcaagtttcacatctaagttgaaacagggtgtgtcataaagtcagttatctctaat

SEQ ID NO: 188365 - DNA, 1291 bp, Homo sapiens
  Payload ID: 17064
  Gene Symbol: SSX2B
  Gene Name: synovial sarcoma, X breakpoint 2B
  Uniprot ID: Q16385
  ENST ID: ENST00000596480
  CDS Start-End: 99-665
actttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgtt

SEQ ID NO: 188366 - DNA, 1410 bp, Homo sapiens; identical to SEQ ID NO: 188356
  Payload ID: 17064
  Gene Symbol: SSX2B
  Gene Name: synovial sarcoma, X breakpoint 2B
  Uniprot ID: Q16385
  ENST ID: ENST00000612490
  CDS Start-End: 71-742

SEQ ID NO: 188367 - DNA, 1344 bp, Homo sapiens
  Payload ID: 17064
  Gene Symbol: SSX2B
  Gene Name: synovial sarcoma, X breakpoint 2B
  Uniprot ID: Q16385
  ENST ID: ENST00000616191
  CDS Start-End: 164-730
cccggctccagggacggaaccttctcaaagtgggggtggagactctaattttcccgcctaaagcatcccctgggattggctactttaagttcagagtacgcatgctctgactttctctctctttcgattcttccatactcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggacccaaaaggggggaacatgcctggacccacagactgcgtgagagaaaacagctggtgatttatgaagagatcagcgaccctgaggaagatgacgagtaactcccctcggggatacgtcacatgcccatgatgagaagtagaacgtggtgacctttcacgaacataggcatggctgcggacccctcgtcatcaggtgcatagcaagtgaaagcaagtgttcacaacagtgaaaagttgagcgtcgtttttcttagtgtgacaagagttcgatgttagtgtttccattgtattttcttacagtgtgccattctgttagatattagcgttttcattgatgagcaagacatgcttaatgtgtatttcggtttgtgtatccatgcacctacctcagaaagcaagtatagtcaggtattctctccatagaacagcactaccctcctctctccccagatgtgactactgagggcagatctgagtgtttaatttccgattttcccctctgcatttacacaccagacacacaaacacacacacacagacacacacacacacagacacaccaagtaccagtataagcatctcccatatgcttttccccattgccatgagtcctggtcaagccccccttcaatttgtttcctgttcagcatgtactcccctcctctgattccccgtatcagtcactgacagttaatacacctttgcaaacgttc

SEQ ID NO: 188368 - DNA, 1232 bp, Homo sapiens
  Payload ID: 17065
  Gene Symbol: SSX3
  Gene Name: synovial sarcoma, X breakpoint 3
  Uniprot ID: Q99909
  ENST ID: ENST00000298396
  CDS Start-End: 54-620
ctgattttctctttggattcttccaaaatcagagtcagactactccctgtgccatgaacggagatgacacctttgcaaggagacccacggttggtgctcaaataccagagaagatacaaaaggccttcgatgatattgccaaatacttctctaaggaagagtgggaaaagatgaaagtctcggagaaaatcgtctatgtgtatatgaagagaaagtatgaggccatgactaaactaggtttcaaggccatcctcccatctttcatgcgtaataaacgggtcacagacttccaggggaatgattttgataatgaccctaaccgtgggaatcaggttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggacccaaaaggggggaacatgcctggacccacagactgcgtgagagaaagcagctggtgatttatgaagagatcagcgatcctgaggaagatgatgagtaactccccttggggatatgacacatgcccatgatgagaagcagaacgtggtgacctttcacgaacatgggcatggctgtggacccctcgtcatcaggtgcatagcaagtgaaagcaagtgttcacaacagtgaaaagttgagcgtcatttttcttagtgtgccaagagtacgatattagcgtttccattgtattttcttgaagtgtgtcattctgttagatattaacattttcactgatgagcaagacatacttaatgcatattttggtttgtgtatccatgcacctaccttagaaaacaagtattgtcagttacctctgcatggaacagcattaccctcctctctccctagatgtgactactgagggcagttctgagtgtttaatttcagattttttcctctgcatttacacacacacacaaaccacaccacacacacacacacacacacacagacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgtt

SEQ ID NO: 188369 - DNA, 800 bp, Homo sapiens
  Payload ID: 17065
  Gene Symbol: SSX3
  Gene Name: synovial sarcoma, X breakpoint 3
  Uniprot ID: Q99909
  ENST ID: ENST00000376893
  CDS Start-End: 95-607
ctctctctttcgattcttccatactcaagagtacgcacggtctgattttctctttggattcttccaaaatcagagtcagactactccctgtgccatgaacggagatgacacctttgcaaggagacccacggttggtgctcaaataccagagaagatacaaaaggccttcgatgatattgccaaatacttctctaaggaagagtgggaaaagatgaaagtctcggagaaaatcgtctatgtgtatatgaagagaaagtatgaggccatgactaaactaggtttcaaggccatcctcccatctttcatgcgtaataaacgggtcacagacttccaggggaatgattttgataatgaccctaaccgtgggaatcaggttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggtgtccttcagagatactgcaggttcggttccagaccactgcaataaagaaatagggaggcccaagaaaaggaagagagacgcggaacagctcatcggtggagcagtcagaagacacaaaacattaatcgattaagtttgtcatattctatgggtgcagttcctggtacccccaaaacaattacacacaacagggtgattatagtcaataataacttaattgtacttaaaaaaactaaaa

SEQ ID NO: 188370 - DNA, 1030 bp, Homo sapiens
  Payload ID: 17065
  Gene Symbol: SSX3
  Gene Name: synovial sarcoma, X breakpoint 3
  ENST ID: ENST00000612497
  CDS Start-End: 24-632
caggtcagactactccctgtgccatgaacggagatgacacctttgcaaggagacccacggttggtgctcaaataccagagaagatacaaaaggccttcgatgatattgccaaatacttctctaaggaagagtgggaaaagatgaaagtctcggagaaaatcgtctatgtgtatatgaagagaaagtatgaggccatgactaaactaggtttcaaggccatcctcccatctttcatgcgtaataaacgggtcacagacttccaggggaatgattttgataatgaccctaaccgtgggaatcaggttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggtaagaggaagcaattcaggaacaatcccactggcttccctggcgacgttcaggtgtgtggactgggtgtgtggcatggatcccagataaccctgggtccaggctgggctgaggagcttgcccagctccagatgagatgttagacatgacttccagagacagactggagttgtcatccatataaaaaaaaaccacgtgacttgaggaaagtcttccaaatttcctcagctccaggttcctagtccataagatggaaataaagaatcatagttcataaattgtttggagacattaaatttaatctagaaggcctgatgacatgaaaggtgctcaagcgattctatctgtgataacctgggatcatatcttactcagctcaatgcctgttacccaatacaggtgtccttcagagatactgcaggttcggttccagaccactgcaataaagtgagtcacacacattgttttttgtttgacagtgcataaaacgttatgtttacactacagtgtagtctactaagtgtgcaatagcattatgtct

SEQ ID NO: 188371 - DNA, 1221 bp, Homo sapiens
  Payload ID: 17066
  Gene Symbol: SSX4
  Gene Name: synovial sarcoma, X breakpoint 4
  Uniprot ID: O60224
  ENST ID: ENST00000595689
  CDS Start-End: 59-625
acacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttcccca

SEQ ID NO: 188372 - DNA, 1092 bp, Homo sapiens
  Payload ID: 17066
  Gene Symbol: SSX4
  Gene Name: synovial sarcoma, X breakpoint 4
  Uniprot ID: O60224
  ENST ID: ENST00000620320
  CDS Start-End: 70-531
tcagagtacgcacacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaaggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttc

SEQ ID NO: 188373 - DNA, 1221 bp, Homo sapiens; identical to SEQ ID NO: 188371
  Payload ID: 17067
  Gene Symbol: SSX4B
  Gene Name: synovial sarcoma, X breakpoint 4B
  Uniprot ID: O60224
  ENST ID: ENST00000595235
  CDS Start-End: 59-625

SEQ ID NO: 188374 - DNA, 1092 bp, Homo sapiens; identical to SEQ ID NO: 188372
  Payload ID: 17067
  Gene Symbol: SSX4B
  Gene Name: synovial sarcoma, X breakpoint 4B
  Uniprot ID: O60224
  ENST ID: ENST00000619890
  CDS Start-End: 70-531

SEQ ID NO: 188375 - DNA, 1261 bp, Homo sapiens
  Payload ID: 17068
  Gene Symbol: SSX5
  Gene Name: synovial sarcoma, X breakpoint 5
  Uniprot ID: O60225
  ENST ID: ENST00000347757
  CDS Start-End: 54-620
cgctctgattgtttcgattcttccaaaatcagagacagagtgctcccggtgccatgaacggagacgatgcctttgtacggagacctagggttggttctcaaataccagagaagatgcaaaaggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgtt

SEQ ID NO: 188376 - DNA, 1384 bp, Homo sapiens
  Payload ID: 17068
  Gene Symbol: SSX5
  Gene Name: synovial sarcoma, X breakpoint 5
  Uniprot ID: O60225
  ENST ID: ENST00000311798
  CDS Start-End: 54-743
cgctctgattgtttcgattcttccaaaatcagagacagagtgctcccggtgccatgaacggagacgatgcctttgtacggagacctagggttggttctcaaataccagagaagatgcaaaagcatccctggagacaagtctgtgaccgtggaatacatttggtgaatctcagtccgttctggaaggtgggaagagagccagccagcagcattaaagctctactgtgtggcaggggagaagctagggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgtt

SEQ ID NO: 188377 - DNA, 1208 bp, Homo sapiens
  Payload ID: 17068
  Gene Symbol: SSX5
  Gene Name: synovial sarcoma, X breakpoint 5
  Uniprot ID: O60225
  ENST ID: ENST00000376923
  CDS Start-End: 1-567
atgaacggagacgatgcctttgtacggagacctagggttggttctcaaataccagagaagatgcaaaaggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgtt

SEQ ID NO: 188378 - DNA, 473 bp, Homo sapiens
  Payload ID: 17068
  Gene Symbol: SSX5
  Gene Name: synovial sarcoma, X breakpoint 5
  ENST ID: ENST00000403001
  CDS Start-End: 1-387
ctcataacctctgctgcagaatgccctcatgcaactgaagtctctctagagtttggaaatctttaccaacaaagaaaaattctgatgtattctctttcagttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctc

SEQ ID NO: 188379 - DNA, 675 bp, Homo sapiens
  Payload ID: 17068
  Gene Symbol: SSX5
  Gene Name: synovial sarcoma, X breakpoint 5
  ENST ID: ENST00000613884
  CDS Start-End: 1-567
atgaatggagacgacgcctttgcaaggagacccagggttgatgctcaaataccagagaagatacaaaaggccttcgatgatattgccaaatacttctctaaggaagagtgggaaaagatgaaagcctcagagaaaatcctctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtg

SEQ ID NO: 188380 - DNA, 1311 bp, Homo sapiens
  Payload ID: 17069
  Gene Symbol: SSX7
  Gene Name: synovial sarcoma, X breakpoint 7
  Uniprot ID: Q7RTT5
  ENST ID: ENST00000298181
  CDS Start-End: 160-726
ccaggctccagggacagaaccttctcaaagtgggggtggagactctgattttcccgcctaaagcatcccctgggattggctactttaagttcagagtatgcatgctctgactttctctctcgattcttccatactcagagtcagactgctcctggtgccatgaacggagacgacgcctttgcaaggagacctagggctggtgctcaaataccagagaagatccaaaagtccttcgatgatattgccaaatacttctctaagaaagagtgggaaaagatgaaatccttggagaaaatcagctatgtgtatatgaagagaaagtatgaggccatgactaaactaggcttcaaggccaccctcccacctttcatgcataatacaggggccacagacctccaggggaatgattttgataatgaccgtaaccaagggaatcaggttgaacgtcctcagatgactttttgcaggctccagagaatcttcccgaagatcatgcccaagaagccagcagaggaaggaaatgattcgaagggagtgccagaagcatctggctcacagaacgatgggaaacacctgtgccctccaggaaaaccaagtacctctgagaagattaacaagacatccggacccaaaagggggaaacatgcctggacccacagactgcgtgagagaaagcagctggtgatttatgaagagatcagcgaccctgaagaagacgacgagtaactcccctcggggatacgacatatgcccatgatgagaagcagaacgtggtgacctttcacgaacatgggcatggctgcggacccctcgtcatcaggtgcatagcaagtgaaagcaagtgttcacaacagtgaaaagttgagcgtcgtttttcttagtgtgacaagagttcgatgttagtgtttccattgtattttcttacagtgtgccattctgttagatattagcgttttcattgatgagcaagacatgcttaatgtgtatttcggtttgtgtatccatgcacctacctcagaaagcaagtatagtcaggtattctctccatagaacagcactaccctcctctctccccagatgtgactactgagggcagatctgagtgtttaatttccgattttcccctctgcatttacacaccagacacacaaacacacacacacagacacacacacacacagacacaccaagtaccagtataagcatctcccatatgcttttccccattgccatgagtcctggtcaagccccccttcaatttgtttcctgttcagcatgtactcccctcctctgattccccgtatcagtcac

SEQ ID NO: 188381 - DNA, 2870 bp, Homo sapiens
  Payload ID: 17070
  Gene Symbol: SYBU
  Gene Name: syntabulin (syntaxin-interacting)
  Uniprot ID: Q9NX95
  ENST ID: ENST00000276646
  CDS Start-End: 159-2150
aatcggcggcagtggcggcggcggcgcgttggagcctcaccaagagccgccgcccgcagcccgcgccggctcagcgcagtctcctcgctccgtgctcgcaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccat

SEQ ID NO: 188382 - DNA, 3435 bp, Homo sapiens
  Payload ID: 17070
  Gene Symbol: SYBU
  Gene Name: syntabulin (syntaxin-interacting)
  Uniprot ID: Q9NX95
  ENST ID: ENST00000399066
  CDS Start-End: 729-2711
atttttaaaaccacgaaatggcagggtacttcatgctgcgtttttaaggagaaagaaaaatctcttcttatggatgtcctgtaaggaaaacaaaaattaaagatgatgtaaaaggtggagccatcttcccgagtatcggatttgtgtttgcttttctgttggcaacaagccttgtgtaccaggatattaacgaataattaagatcctgtccagaagaggagggattttaaagataattgtgtgtgagctatcaggaaataactgttccaggtatagggttcaactttgtgaggagacaagaaaacaagtcagactgtcacagctaatttagggaaagcaaaatggaagtctgaaggctatcaagtaagccagagtgtggtgttaataaagagcctttgggaggcagaagcttgaatgtgatagaagtcagggtgggaaggtgagtcaggaccagcatagggaagtaggatggccttccagctagtgagtggaggtgtgtatatgtgtgtgtgtgtgtgtgtgtgtgtgccacacagacatgtgctattcagtagattagaaaggttaactcattggaagagttttgaagctcatttcagcaactgagataagaaggactactctgtgaagactcaatactcagaaatgtgatttcttagaaattgatccttgaaggaaccgacaggagttaagagagggaaacgcgtttccttttgttttcttttttgatgtccaattttgagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaa

SEQ ID NO: 188383 - DNA, 2983 bp, Homo sapiens
  Payload ID: 17070
  Gene Symbol: SYBU
  Gene Name: syntabulin (syntaxin-interacting)
  Uniprot ID: Q9NX95
  ENST ID: ENST00000408908
  CDS Start-End: 274-2265
accacacacacaaaaaaatctcacgatgccccagaatgcagtttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 188384 - DNA, 2776 bp, Homo sapiens
  Payload ID: 17070
  Gene Symbol: SYBU
  Gene Name: syntabulin (syntaxin-interacting)
  Uniprot ID: Q9NX95
  ENST ID: ENST00000408889
  CDS Start-End: 424-2058
cccatcaggatatttaagctggaagctttgtcaggctgcgtcagtgttccctgagtaagcaggaatgcaaactgcaattttagcattagcattctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 188385 - DNA, 3104 bp, Homo sapiens
  Payload ID: 17070
  Gene Symbol: SYBU
  Gene Name: syntabulin (syntaxin-interacting)
  Uniprot ID: Q9NX95
  ENST ID: ENST00000433638
  CDS Start-End: 395-2386
accacacacacaaaaaaatctcacgatgccccagaatgcagtttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 188386 - DNA, 3072 bp, Homo sapiens
  Payload ID: 17070
  Gene Symbol: SYBU
  Gene Name: syntabulin (syntaxin-interacting)
  Uniprot ID: Q9NX95
  ENST ID: ENST00000440310
  CDS Start-End: 363-2354
actcaggctgaagggaccgattggagtgctggcttgaactcgtttttctgagttcaattccagtgctcttcccttagcagtgtgctggagctacttcctggagccgggcagctgcagggcagcgctggggaaaagactgttctctggctacatagcagcctggcttctccaagccggagggagctgcgctgaccactgaaggcctttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 188387 - DNA, 3226 bp, Homo sapiens
  Payload ID: 17070
  Gene Symbol: SYBU
  Gene Name: syntabulin (syntaxin-interacting)
  Uniprot ID: Q9NX95
  ENST ID: ENST00000422135
  CDS Start-End: 517-2508
agcggcttcttcaagaaacagatcctgcagcataatctgccagggccctggcaacaggaaccggtccttcaggcagcgagcccagggagcagaatcctggcgcccccggcgcgcggccctcagcgtgctcacgccgctgcgccccacccagcggtgcctgccctttggtcccccgcccttctctccattttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaagggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctccc

SEQ ID NO: 188388 - DNA, 2919 bp, Homo sapiens
  Payload ID: 17070
  Gene Symbol: SYBU
  Gene Name: syntabulin (syntaxin-interacting)
  Uniprot ID: Q9NX95
  ENST ID: ENST00000446070
  CDS Start-End: 207-2195
agcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaa

SEQ ID NO: 188389 - DNA, 3007 bp, Homo sapiens
  Payload ID: 17070
  Gene Symbol: SYBU
  Gene Name: syntabulin (syntaxin-interacting)
  ENST ID: ENST00000424158
  CDS Start-End: 271-2277
agacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagatgtccaattttgagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaataataa

SEQ ID NO: 188390 - DNA, 575 bp, Homo sapiens
  Payload ID: 17070
  Gene Symbol: SYBU
  Gene Name: syntabulin (syntaxin-interacting)
  ENST ID: ENST00000533821
  CDS Start-End: 88-575
aattttgtactgcaggctttgctctagaatgtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatat

SEQ ID NO: 188391 - DNA, 594 bp, Homo sapiens
  Payload ID: 17070
  Gene Symbol: SYBU
  Gene Name: syntabulin (syntaxin-interacting)
  ENST ID: ENST00000533394
  CDS Start-End: 161-594
gtgccagatgtcactgagagtgagatcctggggaaggttccactaaaggagtccaaggaaatgcagagcataatttgtgagcagagcaaaatccaattgtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccg

SEQ ID NO: 188392 - DNA, 559 bp, Homo sapiens
  Payload ID: 17070
  Gene Symbol: SYBU
  Gene Name: syntabulin (syntaxin-interacting)
  ENST ID: ENST00000534578
  CDS Start-End: 331-559
attttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaagggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcag

SEQ ID NO: 188393 - DNA, 582 bp, Homo sapiens
  Payload ID: 17070
  Gene Symbol: SYBU
  Gene Name: syntabulin (syntaxin-interacting)
  ENST ID: ENST00000534184
  CDS Start-End: 272-582
agcattagcattctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagaggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccc

SEQ ID NO: 188394 - DNA, 2995 bp, Homo sapiens
  Payload ID: 17070
  Gene Symbol: SYBU
  Gene Name: syntabulin (syntaxin-interacting)
  Uniprot ID: Q9NX95
  ENST ID: ENST00000528647
  CDS Start-End: 287-2275
gcagtgtgctggagctacttcctggagccgggcagctgcagggcagcgctggggaaaagactgttctctggctacatagcagcctggcttctccaagccggagggagctgcgctgaccactgaaggcctttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccat

SEQ ID NO: 188395 - DNA, 1126 bp, Homo sapiens
  Payload ID: 17070
  Gene Symbol: SYBU
  Gene Name: syntabulin (syntaxin-interacting)
  ENST ID: ENST00000529190
  CDS Start-End: 515-1126
cggcttcttcaagaaacagatcctgcagcataatctgccagggccctggcaacaggaaccggtccttcaggcagcgagcccagggagcagaatcctggcgcccccggcgcgcggccctcagcgtgctcacgccgctgcgccccacccagcggtgcctgccctttggtcccccgcccttctctccattttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaagggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctg

SEQ ID NO: 188396 - DNA, 2645 bp, Homo sapiens
  Payload ID: 17070
  Gene Symbol: SYBU
  Gene Name: syntabulin (syntaxin-interacting)
  Uniprot ID: Q9NX95
  ENST ID: ENST00000533065
  CDS Start-End: 311-1945
aatcggcggcagtggcggcggcggcgcgttggagcctcaccaagagccgccgcccgcagcccgcgccggctcagcgcagtctcctcgctccgtgctcgcaggtgcctcctcctggacggcggcagcggcggcgcgaggagccggcgggcagcggcgcgatggggcccctccgcgagagcaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaa

SEQ ID NO: 188397 - DNA, 3244 bp, Homo sapiens
  Payload ID: 17070
  Gene Symbol: SYBU
  Gene Name: syntabulin (syntaxin-interacting)
  Uniprot ID: Q9NX95
  ENST ID: ENST00000533895
  CDS Start-End: 328-2316
agcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaataataattatttctgtgattttacttctatgtataagaaagacaatgaatagcagatcttacatctttatcaatagggggtctgtaaaaattgaattaaattaggaagagggaaaaagagttagttattaaagaaaatgaagatttcctacccttacttaaaaagcatcatttctgaataaaagtagatttgtttacttttaaa

SEQ ID NO: 188398 - DNA, 1983 bp, Homo sapiens
  Payload ID: 17070
  Gene Symbol: SYBU
  Gene Name: syntabulin (syntaxin-interacting)
  ENST ID: ENST00000529690
  CDS Start-End: 129-1730
atgcagaaggctcagtctccatggataccccactctgagactgtactctactgagatatgagctgcacacactgtatttctgcaaaagacataccccagcctgtgctgggaggctgtttgcagaggcaatgtttgccatgaaagtctatggagcttaccttctaagtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctg

SEQ ID NO: 188399 - DNA, 582 bp, Homo sapiens
  Payload ID: 17070
  Gene Symbol: SYBU
  Gene Name: syntabulin (syntaxin-interacting)
  ENST ID: ENST00000526302
  CDS Start-End: 354-582
tttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcag

SEQ ID NO: 188400 - DNA, 558 bp, Homo sapiens
  Payload ID: 17070
  Gene Symbol: SYBU
  Gene Name: syntabulin (syntaxin-interacting)
  ENST ID: ENST00000528569
  CDS Start-End: 319-558
atcaggaaataactgttccaggtatagggttcaactttgtgaggagacaagaaaacaagtcagactgtcacagctaatttagggaaagcaaaatggaagtctgaaggctatcaagtaagccagagtgtggtgttaataaagagcctttgggaggcagaagcttgaatgtgatagaagtcagggtgggaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccg

SEQ ID NO: 188401 - DNA, 516 bp, Homo sapiens
  Payload ID: 17070
  Gene Symbol: SYBU
  Gene Name: syntabulin (syntaxin-interacting)
  ENST ID: ENST00000531230
  CDS Start-End: 414-516
ttctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagaggtgcctcctcctggacggcggcagcggcggcgcgaggagccggcgggcagcggcgcgatggggcccctccgcgagagcaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagca

SEQ ID NO: 188402 - DNA, 559 bp, Homo sapiens
  Payload ID: 17070
  Gene Symbol: SYBU
  Gene Name: syntabulin (syntaxin-interacting)
  ENST ID: ENST00000527600
  CDS Start-End: 339-559
atttgactcttgagcttatttaaacaagtcaccagtccttgactccagaactgaagctttatatgttctttctatttggctgagccagtaatttttgattgcttcttcttcccaagaggcatcaacaaatattgactggatcatctggacctgacttagctgccctttggaaagttctgttcaatcagctggatagagctgtttgttttcctcacctaaccctcacagctatcctagagcccgcgccggctcagcgcagtctcctcgctccgtgctcgcaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagctt

SEQ ID NO: 188403 - DNA, 2498 bp, Homo sapiens
  Payload ID: 17070
  Gene Symbol: SYBU
  Gene Name: syntabulin (syntaxin-interacting)
  Uniprot ID: Q9NX95
  ENST ID: ENST00000533171
  CDS Start-End: 353-2344
cccatcaggatatttaagctggaagctttgtcaggctgcgtcagtgttccctgagtaagcaggaatgcaaactgcaattttagcattagcattctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgttt

SEQ ID NO: 188404 - DNA, 613 bp, Homo sapiens
  Payload ID: 17070
  Gene Symbol: SYBU
  Gene Name: syntabulin (syntaxin-interacting)
  ENST ID: ENST00000534501
  CDS Start-End: 159-613
tttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgag

SEQ ID NO: 188405 - DNA, 2717 bp, Homo sapiens
  Payload ID: 17070
  Gene Symbol: SYBU
  Gene Name: syntabulin (syntaxin-interacting)
  ENST ID: ENST00000529175
  CDS Start-End: 624-1997
taatcaaaattaccaatgatgcatttatgtgtgctctgtttatcttgccctgttttctcctcctcctgtatggggtaccaccttcccccatcctccaaatgaaccgcattaattttcttaccctgacatgaaccaaatgcaaatatttctaaactgaaacaggtggactagaacaaaaaccatatcttgaaaacagcctccaaaataaacagcctccaaaataaacctgagctaaatcaatattctacattgtgtatgttcttagcaggctattgggtgttatccaaaaaaagctttatggtcagaaactatttgaaagaacaacagagggagaggttgcttgtgctgatgtcacaaggagagaaaataccaggcaggtgggaagaaggccgctcctaaggacagtctacacgaataattgtattgcgcctttcaactctataaattggatttccttagatttaaggagtaagacattagcccttgggcatctgtagccccaagaattttaacatttttcattcttttctcccagtcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccat

SEQ ID NO: 188406 - DNA, 748 bp, Homo sapiens
  Payload ID: 17070
  Gene Symbol: SYBU
  Gene Name: syntabulin (syntaxin-interacting)
  ENST ID: ENST00000524720
  CDS Start-End: 337-748
ctcttatgggaaaacaggcagctctctccctggtaagaaaaatatgggtctccaccccaccccaccacacacacaaaaaaatctcacgatgccccagaatgcagtttctttccttcgtgacgtgttgtgaagcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcag

SEQ ID NO: 188407 - DNA, 545 bp, Homo sapiens
  Payload ID: 17070
  Gene Symbol: SYBU
  Gene Name: syntabulin (syntaxin-interacting)
  ENST ID: ENST00000530841
  CDS Start-End: 440-545
agcagtgtgctggagctacttcctggagccgggcagctgcagggcagcgctggggaaaagactgttctctggctacatagcagcctggcttctccaagccggagggagctgcgctgaccactgaaggcctttctgatgcaaccccttccaagtagaatccatcgcagcctttcagatcccggaacccagaggctgtgtcggtcctgacgcactggcttggctgggctccggtgcctcctcctggacggcggcagcggcggcgcgaggagccggcgggcagcggcgcgatggggcccctccgcgagagcaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacag

SEQ ID NO: 188408 - DNA, 2636 bp, Homo sapiens
  Payload ID: 17070
  Gene Symbol: SYBU
  Gene Name: syntabulin (syntaxin-interacting)
  Uniprot ID: Q9NX95
  ENST ID: ENST00000528331
  CDS Start-End: 278-1912
agcacgtcagctgctccttgttgctgtgcagatcacccaacattaggtcaccgagagagacagcagctcttgctcacacagctgataggattaggagatggtgctttgtcagccctgattgagcccaagaaaaccccctgcatacacagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaa

SEQ ID NO: 188409 - DNA, 2765 bp, Homo sapiens
  Payload ID: 17070
  Gene Symbol: SYBU
  Gene Name: syntabulin (syntaxin-interacting)
  Uniprot ID: Q9NX95
  ENST ID: ENST00000532779
  CDS Start-End: 248-2035
ttttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggtgcctcctcctggacagcgcgatggggcccttctgggcgagaaaggatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaataataa

SEQ ID NO: 188410 - DNA, 565 bp, Homo sapiens
  Payload ID: 17070
  Gene Symbol: SYBU
  Gene Name: syntabulin (syntaxin-interacting)
  ENST ID: ENST00000528716
  CDS Start-End: 281-565
tatttaaacaagtcaccagtccttgactccagaactgaagctttatatgttctttctatttggctgagccagtaatttttgattgcttcttcttcccaagaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagat

SEQ ID NO: 188411 - DNA, 564 bp, Homo sapiens
  Payload ID: 17070
  Gene Symbol: SYBU
  Gene Name: syntabulin (syntaxin-interacting)
  ENST ID: ENST00000528045
  CDS Start-End: 188-564
ttaggagatggtgctttgtcagccctgattgagcccaagaaaaccccctgcatacacagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgag

SEQ ID NO: 188412 - DNA, 562 bp, Homo sapiens
  Payload ID: 17070
  Gene Symbol: SYBU
  Gene Name: syntabulin (syntaxin-interacting)
  ENST ID: ENST00000532594
  CDS Start-End: 54-197
atttctgcaaaagacataccccagcctgtgctgggaggctgtttgcagaggcaatgtttgccatgaaagtctatggagcttaccttctaagtagtgaagctgattttagctcctcgagcagcacaggcagcatttccgctcctgaggtccatatgtcgactgcgggaagcaagcggtcttcttcttcacgcaagtaggcaccatctcctgctctgtaattaagacgctttacacagtcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctga

SEQ ID NO: 188413 - DNA, 573 bp, Homo sapiens
  Payload ID: 17070
  Gene Symbol: SYBU
  Gene Name: syntabulin (syntaxin-interacting)
  ENST ID: ENST00000532189
  CDS Start-End: 334-573
attctacttagaacaaagggaggtgcccggaagcagtacacattagtgcagagttttctggtttccctttaaagagaaggcacagccatttgactcttgagcttatttaaacaagtcaccagtccttgactccagaactgaagctttatatgttctttctatttggctgagccagtaatttttgattgcttcttcttcccaagagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccg

SEQ ID NO: 188414 - DNA, 5533 bp, Homo sapiens
  Payload ID: 17071
  Gene Symbol: SNPH
  Gene Name: syntaphilin
  Uniprot ID: O15079
  ENST ID: ENST00000381867
  CDS Start-End: 643-2259
ggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagggttgttgagaggagtcaatggcataatacgggaagccccgaaccacgggccaactgggaagttgatggtcggcgagaccagcccatcctaatttggggttcctggtcctgctccaggagtcctacagcctgcagcccctaccagagagggaggactgaacagcaagggggtgtgtgggtctgagtatcagggtcctggggaagaagcaggcctggctcgtagagtagaagactcggtgccggcagtcaggaggccctgctcctgaagcctctgtgaccttgggcacggccttcactctgtctggggcacattcactcatctggagaacacagggttggactgattacttttagccactcctgacagttgtggttttaagttgggtggtgggaacctgtgcaccagccctattcaattcactggtggaggcagccgtggtctgccaggccctcgctcctggggtgtcctgccgaagggtgagaagagaagccatgccgggcagcggccccagcgagaggatgacgtggcctggcccggccctttctgcgggccccccaacccgccctctctcctcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattctggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctgggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaag

SEQ ID NO: 188415 - DNA, 4995 bp, Homo sapiens
  Payload ID: 17071
  Gene Symbol: SNPH
  Gene Name: syntaphilin
  Uniprot ID: O15079
  ENST ID: ENST00000381873
  CDS Start-End: 237-1721
cagctagccgcctcctgcaggggctcgggagagcaattcggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattctggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctgggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaag

SEQ ID NO: 188416 - DNA, 5354 bp, Homo sapiens
  Payload ID: 17071
  Gene Symbol: SNPH
  Gene Name: syntaphilin
  Uniprot ID: O15079
  ENST ID: ENST00000614659
  CDS Start-End: 467-2083
agacgggaagccccgaaccacgggccaactgggaagttgatggtcggcgagaccagcccatcctaatttggggttcctggtcctgctccaggagtcctacagcctgcagcccctaccagagagggaggactgaacagcaagggggtgtgtgggtctgagtatcagggtcctggggaagaagcaggcctggctcgtagagtagaagactcggtgccggcagtcaggaggccctgctcctgaagcctctgtgaccttgggcacggccttcactctgtctggggcacattcactcatctggagaacacagggttggactgattacttttagccactcctgacagttgtggttttaagttgggtggtgggaacctgtgcaccagccctattcaattcactggtggaggcagccgtggtctgccaggccctcgctcctggggtgtcctgccgaagggtgagaagagaagccatgccgggcagcggccccagcgagaggatgacgtggcctggcccggccctttctgcgggccccccaacccgccctctctcctcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattctggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctgggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagc

SEQ ID NO: 188417 - DNA, 1099 bp, Homo sapiens
  Payload ID: 17072
  Gene Symbol: STX10
  Gene Name: syntaxin 10
  ENST ID: ENST00000242770
  CDS Start-End: 6-668
ctgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcaggcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 188418 - DNA, 1128 bp, Homo sapiens
  Payload ID: 17072
  Gene Symbol: STX10
  Gene Name: syntaxin 10
  Uniprot ID: O60499
  ENST ID: ENST00000343587
  CDS Start-End: 174-776
cggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttatacgta

SEQ ID NO: 188419 - DNA, 940 bp, Homo sapiens
  Payload ID: 17072
  Gene Symbol: STX10
  Gene Name: syntaxin 10
  ENST ID: ENST00000440593
  CDS Start-End: 169-390
gtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcgtctcagcccacgtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttccc

SEQ ID NO: 188420 - DNA, 704 bp, Homo sapiens
  Payload ID: 17072
  Gene Symbol: STX10
  Gene Name: syntaxin 10
  ENST ID: ENST00000587318
  CDS Start-End: 1-685
ggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgttccaggaccccaaagccatttgcccctgtgccttatacacgtgccaacctggaaataaaatgtcagccttttttata

SEQ ID NO: 188421 - DNA, 907 bp, Homo sapiens
  Payload ID: 17072
  Gene Symbol: STX10
  Gene Name: syntaxin 10
  ENST ID: ENST00000591197
  CDS Start-End: 734-907
ctgcctctgcccacaaccaagatggctgaggagagggcggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgagggtgagtgacaacgacgggggagggcggagggtgctctgtacccaagccagccagtgcccgggtgccggccccagcgtgcccggcgggctgggcaaggccgtcggggtgcagagtgggaggcgcacgcaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcag

SEQ ID NO: 188422 - DNA, 1241 bp, Homo sapiens
  Payload ID: 17072
  Gene Symbol: STX10
  Gene Name: syntaxin 10
  ENST ID: ENST00000589083
  CDS Start-End: 54-794
gcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttcccagaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 188423 - DNA, 1073 bp, Homo sapiens
  Payload ID: 17072
  Gene Symbol: STX10
  Gene Name: syntaxin 10
  ENST ID: ENST00000591843
  CDS Start-End: 115-456
tcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcgatatcctggggctttatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttatacgta

SEQ ID NO: 188424 - DNA, 713 bp, Homo sapiens
  Payload ID: 17072
  Gene Symbol: STX10
  Gene Name: syntaxin 10
  ENST ID: ENST00000593126
  CDS Start-End: 1-606
ctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgccctccctggcaggctggtcccttaagcctggggagccaccaagcactttggagctggcctcgccccctaggaggagagggtccctcctgggtagctggagagtagagggtcccgcctggggagctgtcccca

SEQ ID NO: 188425 - DNA, 1136 bp, Homo sapiens
  Payload ID: 17072
  Gene Symbol: STX10
  Gene Name: syntaxin 10
  Uniprot ID: O60499
  ENST ID: ENST00000587230
  CDS Start-End: 66-815
gggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacct

SEQ ID NO: 188426 - DNA, 1164 bp, Homo sapiens
  Payload ID: 17072
  Gene Symbol: STX10
  Gene Name: syntaxin 10
  ENST ID: ENST00000588848
  CDS Start-End: 798-1164
ctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgagggtgagtgacaacgacgggggagggcggagggtgctctgtacccaagccagccagtgcccgggtgccggccccagcgtgcccggcgggctgggcaaggccgtcggggtgcagagtgggaggcgcacgcaggggtatataggggtctccggagtcccccatgcgtttgggtttgcagtcgggggcagaggcaggcgggaggaccgcctgcccccagccgcgcccgccgtgcccctgcccgcagcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcgatatcctggggctttgtggcagagggtggcatgggagagcccattgcggtggcagcccaccttcgggtagggctggacccctagggacggggatgatatctggctccggccttgacccttgactctcagcccacgtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttgg

SEQ ID NO: 188427 - DNA, 291 bp, Homo sapiens
  Payload ID: 17072
  Gene Symbol: STX10
  Gene Name: syntaxin 10
  ENST ID: ENST00000591415
  CDS Start-End: 1-291
atgttgtgtgcccctgcagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggt

SEQ ID NO: 188428 - DNA, 1926 bp, Homo sapiens
  Payload ID: 17073
  Gene Symbol: STX11
  Gene Name: syntaxin 11
  Uniprot ID: O75558
  ENST ID: ENST00000367568
  CDS Start-End: 184-1047
cgcggcggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaacact

SEQ ID NO: 188429 - DNA, 3079 bp, Homo sapiens
  Payload ID: 17074
  Gene Symbol: STX12
  Gene Name: syntaxin 12
  Uniprot ID: Q86Y82
  ENST ID: ENST00000373943
  CDS Start-End: 126-956
gcacgcagccttagctccttccccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaattctcctta

SEQ ID NO: 188430 - DNA, 718 bp, Homo sapiens
  Payload ID: 17074
  Gene Symbol: STX12
  Gene Name: syntaxin 12
  ENST ID: ENST00000440806
  CDS Start-End: 74-718
gcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagctctttgcttctggatatgaagaatgtggccctccaagactttattgatagcagaggactggagccctgccatgaggagtggaaccagatgcagagccaggaggatgaggtggccatcactgagcaggatttggaacttattaaagaaagagaaacggcaattcggcagctggag

SEQ ID NO: 188431 - DNA, 785 bp, Homo sapiens
  Payload ID: 17075
  Gene Symbol: STX16
  Gene Name: syntaxin 16
  ENST ID: ENST00000312283
  CDS Start-End: 173-785
agctgcagtcagatccggggatggagggagccggagaagaggagtgagaaggccggggaggcaggccctgctgtcttcctgcaggccggcagcctgctggcagtggaggaccaggccgtccaggaaaggaaggggtcaggagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttag

SEQ ID NO: 188432 - DNA, 4897 bp, Homo sapiens
  Payload ID: 17075
  Gene Symbol: STX16
  Gene Name: syntaxin 16
  Uniprot ID: O14662
  ENST ID: ENST00000355957
  CDS Start-End: 736-1662
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 188433 - DNA, 4329 bp, Homo sapiens
  Payload ID: 17075
  Gene Symbol: STX16
  Gene Name: syntaxin 16
  Uniprot ID: O14662
  ENST ID: ENST00000358029
  CDS Start-End: 129-1094
aggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcgcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 188434 - DNA, 4273 bp, Homo sapiens
  Payload ID: 17075
  Gene Symbol: STX16
  Gene Name: syntaxin 16
  Uniprot ID: O14662
  ENST ID: ENST00000359617
  CDS Start-End: 246-1064
agatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcagctgttagccgagcaagtgagtagtcacatcacctccagccctctgcattcacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaaca

SEQ ID NO: 188435 - DNA, 4318 bp, Homo sapiens
  Payload ID: 17075
  Gene Symbol: STX16
  Gene Name: syntaxin 16
  Uniprot ID: O14662
  ENST ID: ENST00000361830
  CDS Start-End: 267-1085
acggaaacggtccggggctgagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcagctgttagccgagcaagtgagtagtcacatcacctccagccctctgcattcacgtagcattgctgcgtagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaatttt

SEQ ID NO: 188436 - DNA, 924 bp, Homo sapiens
  Payload ID: 17075
  Gene Symbol: STX16
  Gene Name: syntaxin 16
  ENST ID: ENST00000361770
  CDS Start-End: 1-924
atggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcagccctgccgagccgggcccgggcctgctccgagcaggaggggcggctgcttgggaacgtggggcctcctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataa

SEQ ID NO: 188437 - DNA, 4552 bp, Homo sapiens
  Payload ID: 17075
  Gene Symbol: STX16
  Gene Name: syntaxin 16
  Uniprot ID: O14662
  ENST ID: ENST00000371132
  CDS Start-End: 403-1317
gcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 188438 - DNA, 4937 bp, Homo sapiens
  Payload ID: 17075
  Gene Symbol: STX16
  Gene Name: syntaxin 16
  Uniprot ID: O14662
  ENST ID: ENST00000371141
  CDS Start-End: 725-1702
agatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaa

SEQ ID NO: 188439 - DNA, 553 bp, Homo sapiens
  Payload ID: 17075
  Gene Symbol: STX16
  Gene Name: syntaxin 16
  ENST ID: ENST00000458280
  CDS Start-End: 186-553
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagctt

SEQ ID NO: 188440 - DNA, 855 bp, Homo sapiens
  Payload ID: 17075
  Gene Symbol: STX16
  Gene Name: syntaxin 16
  ENST ID: ENST00000438253
  CDS Start-End: 1-660
ggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttc

SEQ ID NO: 188441 - DNA, 560 bp, Homo sapiens
  Payload ID: 17075
  Gene Symbol: STX16
  Gene Name: syntaxin 16
  ENST ID: ENST00000412911
  CDS Start-End: 199-560
agtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccac

SEQ ID NO: 188442 - DNA, 812 bp, Homo sapiens
  Payload ID: 17075
  Gene Symbol: STX16
  Gene Name: syntaxin 16
  ENST ID: ENST00000464640
  CDS Start-End: 1-609
atggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaag

SEQ ID NO: 188443 - DNA, 874 bp, Homo sapiens
  Payload ID: 17075
  Gene Symbol: STX16
  Gene Name: syntaxin 16
  ENST ID: ENST00000483434
  CDS Start-End: 162-401
cggagaagaggagtgagaaggccggggaggcaggccctgctgtcttcctgcaggccggcagcctgctggcagtggaggaccaggccgtccaggaaaggaaggggtcaggaggtcgggcagggcctcagcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggctt

SEQ ID NO: 188444 - DNA, 942 bp, Homo sapiens
  Payload ID: 17075
  Gene Symbol: STX16
  Gene Name: syntaxin 16
  Uniprot ID: O14662
  ENST ID: ENST00000467096
  CDS Start-End: 142-489
tctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggat

SEQ ID NO: 188445 - DNA, 572 bp, Homo sapiens
  Payload ID: 17075
  Gene Symbol: STX16
  Gene Name: syntaxin 16
  ENST ID: ENST00000460655
  CDS Start-End: 292-432
agatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctgctgttagccgagcaagagctggacgagcttgctgatgaccgtatggcactggtgtcaggcatcagcttagatccagaagcagcgattggtgtgacaaaacggccacctcctaagtgggtggatggagtggatgaagtaagttccatattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttt

SEQ ID NO: 188446 - DNA, 597 bp, Homo sapiens
  Payload ID: 17075
  Gene Symbol: STX16
  Gene Name: syntaxin 16
  ENST ID: ENST00000493301
  CDS Start-End: 1-380
ccgacgctttcttgttgttgcggaataattccatccaaaaccggcagctgttagccgagcaagtgagtagtcacatcacctccagccctctgcattcacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgat

SEQ ID NO: 188447 - DNA, 936 bp, Homo sapiens
  Payload ID: 17075
  Gene Symbol: STX16
  Gene Name: syntaxin 16
  ENST ID: ENST00000476384
  CDS Start-End: 281-520
ccggagaagaggagtgagaaggccggggaggcaggccctgctgtcttcctgcaggccggcagcctgctggcagtggaggaccaggccgtccaggaaaggaaggggtcaggaggtcgggcagggcctcagcagctgttagccgagcaaccagatcaagtcaaatttacgttctgaagtatgtccaaggaaattaagagctggtgcatgaaaagataggaaaacaatccaaatcctagcagttatcaaaagcaagtttataatacagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcaggcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataa

SEQ ID NO: 188448 - DNA, 2713 bp, Homo sapiens
  Payload ID: 17076
  Gene Symbol: STX17
  Gene Name: syntaxin 17
  Uniprot ID: P56962
  ENST ID: ENST00000259400
  CDS Start-End: 137-1045
ctcgtgatgccccgccccgtcgctcctgcgcctgcgccgtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaactgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaa

SEQ ID NO: 188449 - DNA, 2424 bp, Homo sapiens
  Payload ID: 17076
  Gene Symbol: STX17
  Gene Name: syntaxin 17
  Uniprot ID: P56962
  ENST ID: ENST00000534052
  CDS Start-End: 649-1557
gggctctctggaggccgcctttgggggcgtcgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtgtgctgtgggtgacactgcgaggaatgacgcgacgctcgatggtagtgaggctcggaggactgggagcgagaggccggaagcccctgctcgccaaacccagaggtggttggcagaaggtcccacaccttggctccctccttttagctaaccgaggttcagagaggagactttactttgacttttctctccaaattcggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggt

SEQ ID NO: 188450 - DNA, 568 bp, Homo sapiens
  Payload ID: 17076
  Gene Symbol: STX17
  Gene Name: syntaxin 17
  ENST ID: ENST00000531035
  CDS Start-End: 255-377
accgaccggcctcgagcgccccggcgggagagatgggattttggcatgttgcccaggctggccatgaactcctgggctcaagtggtcctcccgccttggcctcccaaagtgctggtattacagacatgagccaccgtacccggccccttcattcacaatttttcataaagattcagtggctccacaaagtctgtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatt

SEQ ID NO: 188451 - DNA, 675 bp, Homo sapiens
  Payload ID: 17076
  Gene Symbol: STX17
  Gene Name: syntaxin 17
  ENST ID: ENST00000525342
  CDS Start-End: 92-298
ccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagtttaggaactacatttgagccttctccaaggatttcatcaactgtggaacaaaaattttttttttttaaatggacagttgcggccgggcgcggtggcttacgcctgtaatcccagcactttgggaggctgagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctca

SEQ ID NO: 188452 - DNA, 858 bp, Homo sapiens
  Payload ID: 17076
  Gene Symbol: STX17
  Gene Name: syntaxin 17
  ENST ID: ENST00000529340
  CDS Start-End: 99-236
gtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaaggtatacatacattaaagaagtaaatcattgtgagatatgagggaatttccttacttcacagcttccctttgaggaaagctcacaattgagaagtactgcctaattcagttgaggaaatagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggc

SEQ ID NO: 188453 - DNA, 542 bp, Homo sapiens
  Payload ID: 17076
  Gene Symbol: STX17
  Gene Name: syntaxin 17
  ENST ID: ENST00000526607
  CDS Start-End: 420-542
cgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaag

SEQ ID NO: 188454 - DNA, 2523 bp, Homo sapiens
  Payload ID: 17076
  Gene Symbol: STX17
  Gene Name: syntaxin 17
  Uniprot ID: P56962
  ENST ID: ENST00000525640
  CDS Start-End: 748-1656
aaggggctctctggaggccgcctttgggggcgtcgggccctcacaggcttggtgggcctggcgcccgtgtggcgcgcgcaagaggcgctgggcggcaagtagggcattggatccgaagtgcgagcgccatggtggctcctcctgtttttcagaagtggcggagcctcgcttggtttcgtttttggaagctttattggaagctggtatagggaggccgcagacgatgcgagcaggacggcctcccggggtcgcggggtggaaaagtttccggcgcgcgtcctgtctctggcgcgctgtaggccccgggtcgccagggtcgctggcgtctgggtcccgggacagacccgcgcatccgttcgctggtgggggcgtttggtgtgtgtggcccaggtgtgctgtgggtgacactgcgaggaatgacgcgacgctcgatggtagtgaggctcggaggactgggagcgagaggccggaagcccctgctcgccaaacccagaggtggttggcagaaggtcccacaccttggctccctccttttagctaaccgaggttcagagaggagactttactttgacttttctctccaaattcggtatctcttccataagtcagaaacattaagcggcgggccggaagaaatcgggcgccactagtatcctgaaaagtgggagctctgggccgatggaaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggt

SEQ ID NO: 188455 - DNA, 941 bp, Homo sapiens
  Payload ID: 17076
  Gene Symbol: STX17
  Gene Name: syntaxin 17
  ENST ID: ENST00000524405
  CDS Start-End: 74-499
cccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcacc

SEQ ID NO: 188456 - DNA, 2138 bp, Homo sapiens
  Payload ID: 17077
  Gene Symbol: STX18
  Gene Name: syntaxin 18
  Uniprot ID: Q9P2W9
  ENST ID: ENST00000306200
  CDS Start-End: 65-1072
cgcgccgcggtcgccggctgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaatgtgttgtcaatgagtctaagttgacaaattcagtggcagcccagccacctcctatcaatcaatcagggaagaaatgcaggggagactggggccctcagtgaggggctgcctggcattactcctccaaagactgctgcccccagaacaggcagggggtgtgggagggccagtttcccgccactgggtccaaggagcctttgttcaaaggaagaagtgggccacggaagaacgggcctgcttctctcgtgcctgtgcttctgacctccaggaactgtaaacaggaacacctatgtgtaactgaaggcatgagacatctgtacaggaagcatcccagcgcccacatgggcatgagacagtctgcactgcgcctggtgaaatgcgtgtgtgtacagacagtccactgggcagcacaggtatcctcatgttctttatttgcacagagtgaaatgtcagaagttacatgtaaatgaattcacagtcaataaagtccacgtctacctggaaa

SEQ ID NO: 188457 - DNA, 771 bp, Homo sapiens
  Payload ID: 17077
  Gene Symbol: STX18
  Gene Name: syntaxin 18
  ENST ID: ENST00000507908
  CDS Start-End: 263-771
ggtctcagtgagggagccgccagaagggaaggagcctcctagcttcccggtcctcacgctcccggagcccacacgccccaaacagacacagaagagctcgctgagctctccgcgcagctaaaccctccaagctttgctgggagaaaccgatgcccgagagcgcgtcgcgaggttcctcctccgccagatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttga

SEQ ID NO: 188458 - DNA, 1380 bp, Homo sapiens
  Payload ID: 17077
  Gene Symbol: STX18
  Gene Name: syntaxin 18
  ENST ID: ENST00000505286
  CDS Start-End: 47-973
tgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggtccctcacctataaaatgcggccaatgagtcacaccaccgtgttgctgaggactcaagtcaatgcacagtggctcaagtaaagaagccaggatgtgccccaggtcacagtgtggacagaaaagaaagccaaaagacaccactgaagtacagcccttttatcaacagcgtcttgatctcagtcccaccaggacgtcgggaagcacctgacacgctacagaacaaacagcccattcagaccagcagcgcgtgcatcaggaaggaggctctgcaggccagacaaactcccctccagcctcaccgccacgccccttcacgctgtcctctccatctgctgctcgtcatccctcagggaaacggaccaagggttcccctcttccctcccacctcggcacccagcagagtcctgcaagacctgatgcg

SEQ ID NO: 188459 - DNA, 1158 bp, Homo sapiens
  Payload ID: 17078
  Gene Symbol: STX19
  Gene Name: syntaxin 19
  Uniprot ID: Q8N4C7
  ENST ID: ENST00000315099
  CDS Start-End: 258-1142
gtgtgaagtaagcaatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatacaatgacacaatagcagcaaagcaagagaagtgcaagacatttattttacgtcagcttgaagttgctggaaaagagatgtctgaagaagatgtaaatgatatgcttcatcaaggaaaatgggaagtttttaatgaaagcttacttacagaaatcaatatcactaaagcacaactttcagagattgaacagagacacaaggaacttgttaatttggagaaccaaataaaggatttaagggatcttttcattcagatatctcttttagtagaggaacaaggagagagcatcaacaatattgaaatgacagtgaatagtacaaaagagtatgttaacaatactaaagagaaatttggactagctgtaaaatacaaaaaaagaaatccttgcagagtactgtgttgttggtgctgtccatgctgtagctcaaaataaagaagctattttaaaa

SEQ ID NO: 188460 - DNA, 2095 bp, Homo sapiens
  Payload ID: 17079
  Gene Symbol: STX1A
  Gene Name: syntaxin 1A (brain)
  Uniprot ID: Q16623
  ENST ID: ENST00000222812
  CDS Start-End: 28-894
gccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaccag

SEQ ID NO: 188461 - DNA, 1022 bp, Homo sapiens
  Payload ID: 17079
  Gene Symbol: STX1A
  Gene Name: syntaxin 1A (brain)
  ENST ID: ENST00000395154
  CDS Start-End: 27-869
ccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccaggtgagtgccgggcccccctgccctccactccagcccacaccagcacccagggctgcactaacctcgccctttctgcccgacacgctgccctgccggggagggaccaagttctcagcctcagggtgctttcctgaagtcctgccccgagccccaacccaaccctgaggagggggccctctggagctcgggtgcccccggccccgcagggagagatgattgacaggatcgagtacaatgtggaacacgcggtagactatgtggagagggccgtgtctgacaccaagaaggccgtcaagtaccagagcaaggcgcgccggg

SEQ ID NO: 188462 - DNA, 783 bp, Homo sapiens
  Payload ID: 17079
  Gene Symbol: STX1A
  Gene Name: syntaxin 1A (brain)
  ENST ID: ENST00000395155
  CDS Start-End: 1-783
atgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagcctcagggtgctttcctgaagtcctgccccgagccccaacccaaccctgaggagggggccctctggagctcgggtgcccccggccccgcagggagagatgattga

SEQ ID NO: 188463 - DNA, 2050 bp, Homo sapiens
  Payload ID: 17079
  Gene Symbol: STX1A
  Gene Name: syntaxin 1A (brain)
  Uniprot ID: Q16623
  ENST ID: ENST00000395156
  CDS Start-End: 29-784
agccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgtaccag

SEQ ID NO: 188464 - DNA, 4664 bp, Homo sapiens
  Payload ID: 17080
  Gene Symbol: STX1B
  Gene Name: syntaxin 1B
  Uniprot ID: P61266
  ENST ID: ENST00000215095
  CDS Start-End: 233-1099
gtgccgcagccgcatcgccaccgcagcccggcagagccgagcccggcccaggcccctgcccctgcccggccctcggccagtcgcccccggccccgcccccgcccgcaggccccccgcagcggccgcggcgccccccggcgcccccagaccccggcctccggcacagaggcgggagacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccccacggcagaccctggtgtccctggacctcaccgggccatggaccccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagccctccacactgtggactggacacctgttttgggagggcacagaaatgtgtatttcttgctacctagaatgcagctgtgtgtgtgtggcgtgcgtgtgtatgcacgtgtgtgtgtgtgttaggggctctctacatggtgtgctttttaatttttttttgttttttgttttttgtttttttcgagacggagtcttgctctgtcacccaggctggagtgcagtggcgcaatctcagctcactgcaacctgtgcctccctgacgcaagcgattctcatgcctcagcctcccaagtagctgggactacaggcgcctgccaccacgcctggctaattttagaattttagtagagatgaggttttgacatgttggccaggctggtctcgaactcctgacctcaggtgatccgcccactttggcctccctaagtgctggcattacaggcctgagccaccacgcctggcctacatgatgtgtttctgtcctgcctgacctacatggtgtgtttctgccctgcgtattacacacacacacacacacgtgcgtgcacacacacttctaaggacgtggccccatctggctttgtctctccagttgtccttgccctgcccccctccccagaggtgctgcccagtgctggtgtggccacacacggctacatcattgtgcaggcagagctccctgcctgcccagcctcagggctctgcatgctcacacctagatcctcatcttcctccatgtctctgcccagcatagccccgagcccctggaagctggtacccctcagtgtgctcacacgtggcaaggccgaggtggccccaggcaggggccataccaggcacaaaccatgcacgctggcatgggtgcggggatcacacgaatgcctcctggaaggaaagggctacttgtaggaatgttactgatgaggcaagatgccaaggacttccctgcagggatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggccctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacactgcgtgtccatcccatgtacccgtgggtcgacacacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcggg

SEQ ID NO: 188465 - DNA, 1208 bp, Homo sapiens
  Payload ID: 17080
  Gene Symbol: STX1B
  Gene Name: syntaxin 1B
  Uniprot ID: P61266
  ENST ID: ENST00000565419
  CDS Start-End: 1-834
atgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggagggtgagcggggcaggcggcctgggggtaggcgggggagcccaaggctgagcccgggctgaggtgagtgatggcagcgggcgggaggccttatctctggctctgacctcttcctgtttctgttttctctcccctcttctccctgccaccctctgccctgtctgtccctgcatctgtccgtgtgtcgatctctctcactgtctgcctgtctcactcctctttctgctgcagaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagaccca

SEQ ID NO: 188466 - DNA, 4178 bp, Homo sapiens
  Payload ID: 17080
  Gene Symbol: STX1B
  Gene Name: syntaxin 1B
  ENST ID: ENST00000569638
  CDS Start-End: 1-615
gccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccccacggcagaccctggtgtccctggacctcaccgggccatggaccccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagccctccacactgtggactggacacctgttttgggagggcacagaaatgtgtatttcttgctacctagaatgcagctgtgtgtgtgtggcgtgcgtgtgtatgcacgtgtgtgtgtgtgttaggggctctctacatggtgtgctttttaatttttttttgttttttgttttttgtttttttcgagacggagtcttgctctgtcacccaggctggagtgcagtggcgcaatctcagctcactgcaacctgtgcctccctgacgcaagcgattctcatgcctcagcctcccaagtagctgggactacaggcgcctgccaccacgcctggctaattttagaattttagtagagatgaggttttgacatgttggccaggctggtctcgaactcctgacctcaggtgatccgcccactttggcctccctaagtgctggcattacaggcctgagccaccacgcctggcctacatgatgtgtttctgtcctgcctgacctacatggtgtgtttctgccctgcgtattacacacacacacacacacgtgcgtgcacacacacttctaaggacgtggccccatctggctttgtctctccagttgtccttgccctgcccccctccccagaggtgctgcccagtgctggtgtggccacacacggctacatcattgtgcaggcagagctccctgcctgcccagcctcagggctctgcatgctcacacctagatcctcatcttcctccatgtctctgcccagcatagccccgagcccctggaagctggtacccctcagtgtgctcacacgtggcaaggccgaggtggccccaggcaggggccataccaggcacaaaccatgcacgctggcatgggtgcggggatcacacgaatgcctcctggaaggaaagggctacttgtaggaatgttactgatgaggcaagatgccaaggacttccctgcagggatcaaagatcaggacacgaccccttcctcacacacccacctcagacctgggagaggactgtgtgtcccccactgccccatcggatgctctgggctctgcctcagggaactcgggtttggggaaatgtctatttcagaagtactggagtggccagtgtggcagtggccactcagggtgggctgggtcctgagacccatccccgacacctctcctgctgaaccctcaggctgctccccacaccagggtgtgactgaggggtacacaggcctggatttctggtgtgaggaaggggctagcacctcccctgttgtgtagccagcacaggcacaatttgtgggtttggtggcaggtaggtggtgcgtgggagaaaggacagtgttagaggtccccactccgtggtctaggatcatgaaaggtgaacacacaagtacacaaatgtgccatgccctggcatggggcttatgtgtgcacaggcaaggcactcggtgtgtgtgtgcggaccccagggtcccaggtcatgtgaagcgtacgtgtgtgtgcattgtatgtgtgtgtacattgtgtgtgcattgtgtgtgcatgtggccaaacagatgtgacctcccagaacacagtacccctccacctctacccgagctcagacagccgagctctcccttgtcctgtgtgtgtgtcagtgtggccacgtgcgtaaccccaggtgggctgtcctgagctgggggcctgcctgtcccttcccagaacgcccctctgcaggacaggaagtctgccccaagtctggccacggccctcctgctcccatctcgggctgcttgggagacatcagagcaggccccagcccccagtcccctcttccggccgcctggacaggacccccattcagcccaggtgtttccggaagtcccacggccttggggccacaggagaagggttgaagcgtggctggggcaccactccccccacctggagtggcattgggcccacagctgcccatctctgggcctcaggtggaccaggggatctctaagggtctgctgtgccctttctatgcgtcctccacatcctatgatgtgcctgcttgttggctgctgtctgtgtgcgtcctggcatgttgtctggaggctggtgtcttttgcatgttcttggacaaatgtgtgctacctgcccaggcgcctgcaaccattgagcccacatgtgccccacgtgtgccctgcgggtggtcccgggcctggccagggctcagtgctcctcttccccctcctccctgttcccacccctcatgaagcacactgcgtgtccatcccatgtacccgtgggtcgacacacgctcttgccacgccctgagcgtgtacacatgatgtgttctatgcattcaccctgccccccagcccgccctgcagaggacaagatgggtggccccggctccctttcccctaaccgcccctgcccgctgtgcagccgtgtgcgttggcgtgtgtttctgtgtcactggcgtgtcacgtgatgtagccgtgtttgctgacatgagcccctgcccccttctctgtttctccgttggtttctagagctctctccctccccttctcagaggggacaggactcctggggcctggctggggcccagagccaggccgccctctcctgttagccctcagagtcccatttctgttagccctcagagtcccatttctattggtgaccaacttgcaaatggataaaacacaggaaaatcctgccccccccttcctccctgcatgtcctgtccccagagccccccaccccaccctgggccaggtcaggccctgtgggacgggagaaatagcaaccaatccaacagcg

SEQ ID NO: 188467 - DNA, 3331 bp, Homo sapiens
  Payload ID: 17081
  Gene Symbol: STX2
  Gene Name: syntaxin 2
  Uniprot ID: P32856
  ENST ID: ENST00000261653
  CDS Start-End: 168-1031
gcagagcgcgcggggcgcggttgccgtggcagcgccggctccagggagggctgctggcgccgggccgggaccgcggggcctgaggcggagaccggagagcccgaggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaaa

SEQ ID NO: 188468 - DNA, 661 bp, Homo sapiens
  Payload ID: 17081
  Gene Symbol: STX2
  Gene Name: syntaxin 2
  ENST ID: ENST00000344271
  CDS Start-End: 1-337
tggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaagggtttcagatgtgtgcagaagcagagagaggcgaccacaagccgaccccccagctccacagttctccatgagctcccacccgcacccgctcccagactattctgaagcccatcccaggcatctgagatttcatcactattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctca

SEQ ID NO: 188469 - DNA, 2151 bp, Homo sapiens
  Payload ID: 17081
  Gene Symbol: STX2
  Gene Name: syntaxin 2
  Uniprot ID: P32856
  ENST ID: ENST00000392373
  CDS Start-End: 96-962
gcggggcctgaggcggagaccggagagcccgaggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaaaagtggataattattgctgtgtcagtggttctggttgccataatcgctctaattattggcttgtcagttggcaaatgatggtgtggataacgtcagtgtgcatgcctctctgccagggtgggaaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctccccc

SEQ ID NO: 188470 - DNA, 3231 bp, Homo sapiens
  Payload ID: 17082
  Gene Symbol: STX3
  Gene Name: syntaxin 3
  ENST ID: ENST00000300150
  CDS Start-End: 576-1352
agggtgacagatcgctataaactggtcataagccatgactaccagcaggacacaatcagccccacccaagaagacaaagaaaaacatctgggtgccacatcccgtgatggaaacaggagttttgcccattgaaaggaggtttgccaaggccaatggggtgatggaagatgtatagaagatttctagaactgccagattagccaggaaaaagtacatgggggtgtggagggaatgattgatctgaacaatgactgcaattgtagcatttccaccgaggctggtcagatacatcatcaggaagaccacaaaaatcagcatctggacctcagggtcaggtctaatggaagaggaaaaccagaggggagtggtacacttccacttccacttcttttcaacagacctggtggtggcttcctttataattgtggccttgatgttgcaccaagaagccttgttggacacttcacctttgggcccacagtctggcaagatcccttcctccatattccaataagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtg

SEQ ID NO: 188471 - DNA, 3299 bp, Homo sapiens
  Payload ID: 17082
  Gene Symbol: STX3
  Gene Name: syntaxin 3
  Uniprot ID: Q13277
  ENST ID: ENST00000337979
  CDS Start-End: 548-1417
agcttgtccccgcctagcaaggagtcggctaagaactggatcctagcgaggagcccggcacagacagcgaatgaccgcagccagacagtcgctcttgctcttcctcggccctgcggcaggatccgccggtgcaggggcctctccccggactccacgcgtgtctggagggctctcgggttagggaagggggctttggagacgccccgggcggccgggcggtggcgggacgcgggccctttaagaaggagcgaggggcgcggccaggtaggggcgggtccagggcggatcagcgctgcgccggcgccggcccgggagccggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtgaaa

SEQ ID NO: 188472 - DNA, 615 bp, Homo sapiens
  Payload ID: 17082
  Gene Symbol: STX3
  Gene Name: syntaxin 3
  ENST ID: ENST00000528805
  CDS Start-End: 1-615
atctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagaaattgataattatcattgtgctagtagttgtgttgctgggcattttagcattgattattggactttccgttgggctgaattaa

SEQ ID NO: 188473 - DNA, 1571 bp, Homo sapiens
  Payload ID: 17082
  Gene Symbol: STX3
  Gene Name: syntaxin 3
  Uniprot ID: Q13277
  ENST ID: ENST00000529177
  CDS Start-End: 155-988
ctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatattta

SEQ ID NO: 188474 - DNA, 534 bp, Homo sapiens
  Payload ID: 17082
  Gene Symbol: STX3
  Gene Name: syntaxin 3
  ENST ID: ENST00000530221
  CDS Start-End: 1-231
atgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaattgtgtctcttcttattcctcctccttccatgtgaccaggggatctaaaagtcagcttattacagcattgagcattcaacttcatcttgaaagataagcaacagtgagatgaacaacctctcatagacaggtggttggttgattttttttttcccctcttttttctggcacttggagtctagcccttgacttttttgtatgtgaactttaaattttggtttggctctgaacaatctgattgaaatagatgttgaaattttaaaaagatataaga

SEQ ID NO: 188475 - DNA, 1024 bp, Homo sapiens
  Payload ID: 17082
  Gene Symbol: STX3
  Gene Name: syntaxin 3
  ENST ID: ENST00000533637
  CDS Start-End: 231-362
ggatttggagcgcgaggcgccggtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggatccatgattgaccgtattgagaacaacatggaccagtcagtgggctttgtggagcgggccgtggcagataccaaaaaggctgtcaagtatcagagtgaagcccggaggaaactgatttcactccagactggtgtggccacccttgtcttcagatgagaatggagtctgaatggccttcctgagagcgagtgcgacccgttcctttgtttccttgca

SEQ ID NO: 188476 - DNA, 3111 bp, Homo sapiens
  Payload ID: 17082
  Gene Symbol: STX3
  Gene Name: syntaxin 3
  ENST ID: ENST00000633708
  CDS Start-End: 209-1072
gtgggggcggagggggctgcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggatccatgattgaccgtattgagaacaacatggaccagtcagtgggctttgtggagcgggccgtggcagataccaaaaaggctgtcaagtatcagagtgaagcccggaggaagaagatcatgatcatgatctgctgtattatccttgcgatcatcttagcttccaccattgggagcatatttgcctgaaaaagattgatcgactggcatttctaatcctccttccacttctgtggtaccatcacttctccacgcagactcctcatcagcttctcctctttccattatgaaacttcttaagaaacagggcaccaatcaactacttattaagaattatgcaaagaataaacgtatacagaattgggcggaggacagggacagggagtacagatacatagctgattaggcagatggtttaaaggaggactgcagggtagagaagcaagcagagtgggcgcctctttaggaagtgacacagcctgcatgtgcagtatggctgtgaaggggcagatatcatagcacacctaactcaacaggatcttacttgaactgctgtgagttggtcaagtcagggcacttctgctcttcaggctcctctaggtcacacctttgaccaccctacatctgtttcctctttcaggctccagtagtagtcttaaaagtgaagtttatctaaggataagcacatgcctatcttgctcactgctgtgtccccactttttagcacagcgcctgctgcttacaggtactcaaatatctgctgacttaattacttataattaagctcttatttcagtcatggacaaatccttgggtttgactcctaaactctttaaggtaccaatgagaacgtggtttgttactgtcagaggctgtgtaaagccgcttgggaatgggctgatctgcttatgcaaaaatgctaccaacctttcaaaccccattaccacaacatgaaaatttaaagtgctttttctatgggtggtgatggtggagttctagcaacagcctcttaatctgtggagaagatggctggctccaggactgtggttcaataacgaaatacaggcccacaaaataaaataggtttatagcatgactgaactcacacatcagtagaacactctgtgaaccataacaaagaacagataaaggtgtcaagtgagaaaggtgaaatgaggttatcactcacttcacctctcacctgatttgtgttgctagctgaaactgctggccagtaacgtatgtataagaaactgttataggccgggcacggtggctcatgcctgtaatcacagcactttgggaggccaaggcaggtggatcaccagactgaccaacatagtgaaaccccctctctacaaaaaatacaaaaattagccaggcatggtggcttgcacctgtattcccagctacttgggaggctgaggcaggagaattgcttgaatgcaagaggcggaagttgcagtgagccgagatcgcgccactgcactccagcctgggcaacaagagctaaattccatctaaaaaaaaaaaaaaaacaaaaaaaaaaaactgttcttaatacttaatactgtccccaattccattcaaggttcagttgtgttcagctttaaaaccagctatgtgaatgtgagttctagtgcagattatttagtgattatgtaactaaaattgatgaaaaaatcacactatacaactgtgaggagcacacaactgctaagtttgtacttttgaaagtaaattattctttgtttgataccttattttttaagaaagtgggattaaaaatattttggtcagtgctgttttctacccaccttcaaaagccaatggtttgatatttctattaatttgtgcttcctttagttttaataggggatagaagactgcagctggttgggtctggaaaacattaatctgggcaaacggagctggagctatgaggatctgagtcctagggggccctcattcactagcagtaagaatttaagtggtgcatggcacatagcactgtactagattctgcaggggcacaaacatagagccaaacactctccctcttggagaatttcagacccagaaaaggccacgcagttctaacttttgtcatcggttccttttgctaaaaggcaaagggtatgttccttgcctattgtccaacataccccttccaagattgtgagaagatgggtagctgggcatcaataaatattgaatcaattgaccta

SEQ ID NO: 188477 - DNA, 1481 bp, Homo sapiens
  Payload ID: 17083
  Gene Symbol: STX4
  Gene Name: syntaxin 4
  Uniprot ID: Q12846
  ENST ID: ENST00000313843
  CDS Start-End: 316-1209
cccagcctcgggcaaggaagagacgcgaccatgtgcgcatgccccgaatttatcacggaggggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcatagaaa

SEQ ID NO: 188478 - DNA, 1498 bp, Homo sapiens
  Payload ID: 17083
  Gene Symbol: STX4
  Gene Name: syntaxin 4
  Uniprot ID: Q12846
  ENST ID: ENST00000394998
  CDS Start-End: 344-1231
acccactgcctcgaaaggcctctgggggtggtcggcgcgcccctccccacctcgcgggggccgtgtgggcgtcgctcggtcgttggggtgccggggacgtcgtgatgagaacggcgtcccagagacggcggtgacagagccgggacacgtgacagtcacagggtcacattctgcggtccacgagtttgggaccgggctggtcacgtgacgcgatttccgttggaagatgcaacggttccggtgacggtagcaagttctcgcgtccaggcatctccgcttccgctcggggcgcaacaacttccgactccaccttcccagcctcgggcaaggaagagacgcgaccatggggatgacagctcggacgaagaggacaaggagcgggtcgcgctggtggtgcacccgggcacggcacggctggggagcccggacgaggagttcttccacaagccctctcggtcaccctccccaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcat

SEQ ID NO: 188479 - DNA, 571 bp, Homo sapiens
  Payload ID: 17083
  Gene Symbol: STX4
  Gene Name: syntaxin 4
  ENST ID: ENST00000457779
  CDS Start-End: 46-571
gagatttctgccttggctgaggtcccatgatgctgacagccccaaatgctaagtcgtcagtccgcccacgccctggacccgaaagcaataaaggcgagatttccgttggaagatgcaacggttccggtgacggtagcaagttctcgcgtccaggcatctccgcttccgctcggggcgcaacaacttccgactccaccttcccagcctcgggcaaggaagagacgcgaccatggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaa

SEQ ID NO: 188480 - DNA, 842 bp, Homo sapiens
  Payload ID: 17083
  Gene Symbol: STX4
  Gene Name: syntaxin 4
  ENST ID: ENST00000460668
  CDS Start-End: 260-454
ggaggggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaagccctctcggtcaccctccccaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtcc

SEQ ID NO: 188481 - DNA, 983 bp, Homo sapiens
  Payload ID: 17083
  Gene Symbol: STX4
  Gene Name: syntaxin 4
  ENST ID: ENST00000496977
  CDS Start-End: 260-454
ggaggggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaagccctctcggtcaccctccccaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcag

SEQ ID NO: 188482 - DNA, 649 bp, Homo sapiens
  Payload ID: 17083
  Gene Symbol: STX4
  Gene Name: syntaxin 4
  ENST ID: ENST00000613541
  CDS Start-End: 1-346
catgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaagggtgagctcctgggacctcagacagatccttccctctgatcctgccctgttgttggtatatctggggagtgtgtggcccagagaagccagtgatatatccaggtcacacagcaggcctgggtctagcatctgtctcctggcctccaggccattgtactctccacagcacaagtccgcctctcaggttcttttatttacaatgaaaccatttacttacacagttatcgctgcccactgggcattctttgggcagggagatggagttttgttaggtggcctctgcatacctatgggaactcagtgatgtaatgcaaagaaaaataaacttactttctcctctta

SEQ ID NO: 188483 - DNA, 1794 bp, Homo sapiens
  Payload ID: 17084
  Gene Symbol: STX5
  Gene Name: syntaxin 5
  Uniprot ID: Q13190
  ENST ID: ENST00000294179
  CDS Start-End: 155-1222
gggggtggggttacgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctca

SEQ ID NO: 188484 - DNA, 1785 bp, Homo sapiens
  Payload ID: 17084
  Gene Symbol: STX5
  Gene Name: syntaxin 5
  Uniprot ID: Q13190
  ENST ID: ENST00000377897
  CDS Start-End: 108-1073
cgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagagtgtccttttgtttcctcttctcccggccttgtccccaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctca

SEQ ID NO: 188485 - DNA, 1568 bp, Homo sapiens
  Payload ID: 17084
  Gene Symbol: STX5
  Gene Name: syntaxin 5
  Uniprot ID: Q13190
  ENST ID: ENST00000394690
  CDS Start-End: 119-1024
tcgggtttcggcggcttcagtgctcggggaggaggcagtgacggccggtgagattggaagtggcggcggcggcaggcggcagaggggagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttct

SEQ ID NO: 188486 - DNA, 723 bp, Homo sapiens
  Payload ID: 17084
  Gene Symbol: STX5
  Gene Name: syntaxin 5
  ENST ID: ENST00000431400
  CDS Start-End: 1-476
tcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggtgagatacactctctcgccccaaacagaggagctttctcttccccgtggattggcatcttaaagtccccagggactgcttgatgccttttggaagatagagtgaattctgcccacccatgggacccagttcacctgcttccatccacccaacaagtttttattgagcacctgttcatgtgaggcactgttccaggtgcgggagatacagtggcaagtagaacagtaaagtctgtctggagctgctttgta

SEQ ID NO: 188487 - DNA, 1719 bp, Homo sapiens
  Payload ID: 17084
  Gene Symbol: STX5
  Gene Name: syntaxin 5
  ENST ID: ENST00000491231
  CDS Start-End: 109-861
tcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggtaagtcacaggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgc

SEQ ID NO: 188488 - DNA, 1627 bp, Homo sapiens
  Payload ID: 17084
  Gene Symbol: STX5
  Gene Name: syntaxin 5
  ENST ID: ENST00000492066
  CDS Start-End: 98-343
cggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcaggcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgca

SEQ ID NO: 188489 - DNA, 604 bp, Homo sapiens
  Payload ID: 17084
  Gene Symbol: STX5
  Gene Name: syntaxin 5
  ENST ID: ENST00000488303
  CDS Start-End: 1-202
agtctttggtcgggtttcggcggcttcagtgctcggggaggaggcagtgacggccggtgagattggaagtggcggcggcggcaggcggcagaggggagtgaccctcgtccctccccctcccgacaccatgtcctgccgggatcggacccaggagtttctgtctgcctgcaagtcgctgcagacccgtcaggctggagtgtagtggtgtgatgatagctcacttgcagtcttgaactcctagactcaagggatcctctttcctcagcctcctgagcagctgggactacatggatgcaccactcagctaattttaaaattttttcgtacaggcagtgtctcactatgttgcccagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagc

SEQ ID NO: 188490 - DNA, 560 bp, Homo sapiens
  Payload ID: 17084
  Gene Symbol: STX5
  Gene Name: syntaxin 5
  ENST ID: ENST00000486437
  CDS Start-End: 118-354
agtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcaggctggagtgtagtggtgtgatgatagctcacttgcagtcttgaactcctagactcaagggatcctctttcctcagcctcctgagcagctgggactacatggatgcaccactcagctaattttaaaattttttcgtacaggcagtgtctcactatgttgcccagaatggaatccagacaaataagccagctttgcgtgctgtccgacaacgcagtgaat

SEQ ID NO: 188491 - DNA, 4851 bp, Homo sapiens
  Payload ID: 17085
  Gene Symbol: STX6
  Gene Name: syntaxin 6
  Uniprot ID: O43752
  ENST ID: ENST00000258301
  CDS Start-End: 239-1006
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggacttaagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaa

SEQ ID NO: 188492 - DNA, 4809 bp, Homo sapiens
  Payload ID: 17085
  Gene Symbol: STX6
  Gene Name: syntaxin 6
  Uniprot ID: O43752
  ENST ID: ENST00000542060
  CDS Start-End: 487-951
gagagagagagagagaggagagagaggagagagaggagagagaggagagagaggagagagaggagagagaggagagagagagagagagagagatatatgccctggtcacgtgagcggggtgcggaagtcgtgtttcaggcggcgttcgtgattggccgcggccgagggtcccgggggtggggtcaggccctccgacgcttcgggaggagccgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggacttaagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaattcaacttgaaaa

SEQ ID NO: 188493 - DNA, 1090 bp, Homo sapiens
  Payload ID: 17086
  Gene Symbol: STX7
  Gene Name: syntaxin 7
  Uniprot ID: O15400
  ENST ID: ENST00000367937
  CDS Start-End: 251-970
gagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagaaaaaggattcctgcatgttgatgtgaggtacaaacgccattaaagaaatctacaactgaaccaggaatgaagaacggaacaaaattcttaaccattcggttttcaatgacagcattatgattttgtttgctctgtggttttgtttg

SEQ ID NO: 188494 - DNA, 15791 bp, Homo sapiens
  Payload ID: 17086
  Gene Symbol: STX7
  Gene Name: syntaxin 7
  Uniprot ID: O15400
  ENST ID: ENST00000367941
  CDS Start-End: 115-900
ccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcggtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagctcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaatttgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaagaaaataaagtcattgtccaccttaatagctaaggtccacaagggtaacttatgcagcatttattttttttgaaagtcaaaattgaatttatttctttcacatggctggtttgctgcaatatgaagtttcagaatgggctgaagtaagttgattgagggatttgagttgaatgacattttcaagttcatttaaatatgataaaaattcattggtggtaaataacatctgtctttcctggaaaaaaaaaagttgtgtattttcatgattcagttaaaacaaaaaatgagcctgtgaatcccaggcctttttagtcctccataacatttgaacagtttgacttgtcagcaaagaaatacacttatcaaattttaaaccaatgggagcctgaaagtgttacagtgtactgcttctttgacaaaattctgtttaacaactaccctaacataatttataaatcaattaagataaaaccatttttttctgagtatttaggaatttgtgtcctcaaaatactgtgacatgaaagataggaaagaaattacctggttgccagacatgcacgattatctttcctcatttcagctggattttccaaagtcagtagattggataaagcagcatctcattcactgaggtcacaagataggtaggaaacttctttaatgtgaattttgcatattttaacaattcagttagaaaaacagaaaccacttgatggattataagtgtaaagtgttttaacatagggaattagacatcaaaagggtgggtgaggaaggtgtctgcggccccaaagtgggtggatctcaggagctggcccaggcactgctgtgactcttgagaacatccagaaggctgtgctgttggcgtgcagcactgacagtgtgtctcagggagctgtccccagctgtcagctgttaatagctccaaagccagtgccttgcaagagattttgaaactgctgtgaaactcatgtcctctgcccgcctacacttctgtctgcagtggcctctgaggaaagatggtctctccttttctcatggtcaactctcaacttagaaccagagacagaaggagtttgtgggaagtgtggtttctggtctacctgcactgcagaggacattctagaaagagaagtgagttgacagtctagcataattgtgaaacaaacactgagatgtacagttcaaaccacgtgaagtggaagcctcagaattttcctcactttcattaaagattctttgatggaaaaatttagaagcattggctctagatggtaagcaagtcatttttttccaaccaaaataaaaaatacatatactaagcttctggggccccaggacttaacacagtttccttccttccttcccttcttccttccctcccgtagtagttgcttaataaatacttaatttggcacttatttggggccggctttttgccaggctactacatgcctgggcatagtgttctaagagtgaaccaaaagaataagcttcctgccctcagggagtttatgttttgttatttggcatataaaaagaacttggtgtgttaaaagaagggaaatagctgtgtgaaaggaatgaggcaaggaagaaagggaatgtctaaatataaatctccgtttggaccagcctcctgtttatccagttttccttactaagtaactgaatttcattttcttttcttaattgacagactaccagaaaattgctagttttctaaagagaaactactgatttgagtgatgatctgtgtgtaatggctccaaaaaggagccgttctcttggtggcagcagttggattcagagcttgggcatcctgatcatcaggacagacatttacaggatatgtatagaattactgccccaaatagagggcaaagcactagacagaagggtgagatccaaggggaatttggaatctatatttcatcagaatgcactcaaagcaaaaacagtaagtatgctccatataaagaaatgtttcttaaaatgtttttaatttaaccctacccatcccttggcaaatctttttcttttaaatcaaataggaataaagaagaaaatcttcctattggcccattttctcattattcaaataccatatcaatacaccaattttaattctttgtttttgtaatcatttggttaacatgaatattatgtaatatttttctccaaataatcctaattttaaatgcagaaatagagctaaataacacactaaataggtttttgtagacactgtagcttctggcaagtttttaagaggttggtcacttaattgcttagagtgggattcccgtaggttttgtgtagtgatggcatttatgcttaaaatgtaagtggtggaaggcaaaaccagatttcctgtccagtcgttacacgcacaacacctctacttgttgacgagggagttttctagaactgaattgaatctttaaataaacttgaaagggcattaattcccactttggccaacccaaagtacaaatttttaagtgtttactgtaagtatcgttaggcagtagttactaactccaacacctaatagcattggtagaaagcttataaatgcagttatttagcctcgactaagatttttctgatacctagtttcactttttaatgccctctgaaagttttttgatcagttgtttaatgggagatctgaaatgttaaactcagaccagaaagaagagaacctgttttctagaaattaggtttttaatccaagtaagatgcaagcttttgcttttttaataacttgtatagctaaaaacttgacggtgaaaagctctcagatcaaagctgatccttctgtcagtaatgattctaaaaataagcaagattttaatggggaatatattttatttcattcttatctcaaacctaggtactgtggtcgttttgagttcatttcgaggcattttcaatgtgcctcaggccacatccaacctcttcccagggccagatttaatgttcagcctcataaaggttatcatagttttaacatttaagtactattttgcagtgggtatataccaaaatttgctaatagtaagataaccttagttatatatcattcacgttagttctatcttggaggcaataaacatttcttgttcaagaaattcatgttctatcttggaggcaataaacaaacattttttgttcaaaattagggctaccctattgtccttatgtcttttcctgatctgtggtcaaacatttttcttagtcatttagaaattttctatgttgttttaaattttctttaaatctagaatggagtatgtgaccaatactttcctttggaatggtatggacatttgaaatagagcccattctttataaagtataaaatatgtttaatgctagtatttttaactaaacttttgagaaactagattcacatgctgttgtaagaaataatacagagacctctttcgtgtacctttcactttgtttcccacacagtgaacatctttcaaaactgtcatacaatatcatacccaggatactgacactggtatagctaagatagagaacgtttccacacagaactttttctagcacagggatccctcatcttgcttttgatgaccatacccacttcactcccatccctactcccttcttaacccttggcaaccataatctgttctccatttttatagtttttttttttttcatttcaataaagctgtataactggaatcataataatatgtaaccttttgggattggctttttttcatttagcatgattttctggaggttaatccagcttattatgtgtatcaagtctattgacaggtactttttagtgtgaatagaatcccatagtatagatgtaccacagtttgtttaactgttcacctgctgagagacattgggccagtttttggctactataaataaagttgctataaacatttgtgtacaagtttttgtgtgaacataatctagttttctgggtcaaatgcccagcagttatatagtagttgggtcatatagtagttgaatgtttagtttttaagaaattgccaaacttataccaagtagctgtactattttatatacccaccagtggtgtatgagtgatctagttgcttcatgtccttttcagcatttggtggtgtctcttttttattttagtcattctgataagtgtatagtgacagctcattgcagttttgatttaccattttcccttcgctaatggcaatgatgttgagcatctttgtttcatatgcttatttgccacctgtatctcttctttagtgacatgtttcttcatgtcttttctaattggattttttttctgttgagttttgagggcttttaaataatgtgtgtgtgtgcctctgtgtgtgtgtgtgtgtatttttttctagatactagtcctttgttggatgtgtgatttgcaaatatttcctcccagtcagtagcatgtcttttcatttctcttttctgggcctttcacagagcagaagtgtttaattttgatgaagtccactctatccatttttctttttatggatcatgcttctggtatcaagaactttgcctctctccttagatcccccaaattttctcttttatgttgttttctaaaagtattatagtttacgttttacttttaagtctatattccattttcagttaattttgtataaaatgtgagacttaggtctgggttcattttttttgttgttgcctatggatattcaattactccaacatgatatttgtcgaaaaggctcttttttgtccattgaattgtttttgcacctctgtcaaaaatcagttgagcaaaaatgagttaatgagaaatcagttgggcacattcgtgtgggtctatatctgggttttctattcttttccattagactatgtgtctatacctccaccaacaccaaaatcttgattactgtagtaagtcttgaaatcaaataggctggtttattccactttctttttcaaaattgttttagccacttagttcctttgtcttcccgtataaactttggaataatcttgtctgtatctattcaaatatcttactgggattttgacaggaactatgttatacctatacatcaatttggggagatttgacatctttaccatgttaagccttcccgatcatgatcacaggatcacttcacttcatttcagttaaattttgttttccttcatcagtattgtgtggttttcagcatacaaggtctgtacatgttttgttagatttatacctaagcaatttaatttttgagagagattgtaaatggcattgtattttgaatttcctgttcacatgtctattctaagtacatagaaataaagtgaatttttctattttgtatactgagaccttattgagcccacttactcattttaggggattttgattgattccttgggattttttttttatatagatagtcatgtcatctgcaaataatgaatagttttatctcttcatttctgacctatattccttttttttttcctttcagtcccttaatgcagtgggtagaaattccagcagaaataaaagcagtgagagtagagatccttggcttgtttctggtcttaggcagaaaggattcagtgtttcaccatgaagtataatgttagctgtaggtttttaaagtagatgctcttgctaaagttaaggaagttatcttttattcctttttttctgcaagtttttattatgaattttatgttgaattttgtcaaatgctttttctgccttaatttacataatgccatttttcttctttagcccattcatgtggtagatacattgattgatttttgaatgttgagccattgttacatccctgagataaactccacttggtcgtggtgtatctttgtatatatagcttaattcttttggctaatattttgttaaggatttttgcatctgttttaatgcgacatactggttggtggtatcagggtaatactagcttcaaaatgaactggaaagtattcctttctcttctgttttctaaagcggattgtatagaattggtgtcagcgctttttaaaacatttgatagaactttccaatgaaatcatctgggcctggagattttgggggagggagttctttttattgtaatttccacttttacaatagttatatggctgtttaatttatctatttcatattgagttgtgacagtttgtatttttagatgaattagtccatttcatctaagctctcagatttatatgtagagtttttggttgtattttttgttagacttttgatgtctgatattccaaaactccttcatttatcatttcctttctgtttagagcactcctttagccttattattattattgtagttccattggcaacaaattctctcagttttctttcatctgaaaatgtcttgattttcccttgatatctgaagaatatttacattagacatagacttgtaggtttatagttcttttctttcagcacttgaaaattgttctgccacttccagccaagaggggtggctcacgcctgtaagcccagcactttgggaagccaaggcgggcagatcacttgaggtcaggagtttgagaccagcctggctaacatggcgaaaccccgcctctactaaaaatacaaaaattagccggcatggtggtgcacatctgtaatcccagccatttgggaagctgaggcaggagaatcacttgaacccgtaggcggagattacagtgagctgagatcgcaccactgtactccagtctgagcaacagaacgagactccttgtcaaaaaaaaaaaaaaggaaagaaaatttcatggttccccatgagaaatccagttttttaaattgttttggtccctatagataggtgtcatttgtcttttttctttttctttttttcctttgtgtttagtttttagttgtttaaccatgatgtatcttgtagatttggggggtttattatatttgaggtcttctcaccatctatatgtttatgtcttttgccaattttggggagttttcagctgtcatttttttcaagaactttttcagtcttccttctttcttctttcttttgagactctgatgacacaaatgttagatttattgtagttccgtaagtccctgaggttctgttcatctttgttctgcctgttttcttctgttgttcagactgtgtaatttctatcattttatcttcagatttattcattctttctgcagtagcttccattctgctattgagcctatcaattaagtgtttcatattgattcctgcatttttcaattttaaaatttctggccctttaccgaaaatgttggttgacccctggagtataaacctatactatagaagagagtatcaatttttttttttttgagaggatcaatttaaacaaaagttggtctctttaaataaataaagtacacataacttggtgaaaccgatttggaaaaaaacagaagacataaaaaatttaggaatgaaagtacagataaataaccaaacatagattttaaaataataagacactataaacaactttatgccaatatatcacaaaacagaaaatgaataatttatatgaaaaatgcaaattaccaaaatcaactacgaagtagatgatttctgcttcctgccatatggttgactaggtatactcaaggatcctcctgctaaaatacagttagttcttggataaaatacaacacacataatattagttcatttcctggctcattagaaagaaagataatcactaaaggctattaccaatgagagtgggctaaaattaaagtagttgagaaacaggaaaactgtgcctctgagacttaagccatggactccaggcaaagtaaagaaagtgaacctaagattccttcataaaaccaggaatgctttaaagcattaaagtagtcctaagtcagtggactctggtggttactctaagaagtggatgaaaatcccctccgaaggaaagcctccctaattaatgcttctagattaatcaaacatgcaaggaaacacaccatttgcattgagaaacagtagatttagatattcaaggaattcaggtattgcaattagcagaagtagaataacagttatatgtttaaataatgtatgaattaaaacgaacatgaaatgagagatgtgttaaaaggcagatattaaaaagaaccaaagacaacttaggtatgaaatttaattattgaaatatataacataatgaatggtttaagagcagattcaccacaactaaaggaattgttgactatcaagttttaactgaggaaacaacatattgcagcaaaaacaggtaaagggatagaaaataagaattagagattatgagacctgaaggatagaatgggaaggtttaatatgtgctgattggagtctaagaagtaaaaaatagaaaaaaattgaggtaattgctgacaaatttccagagctaagaaaagcctgggacctggtatggtggcttatgcctgtaatcacagcattttgggaggccaaagcagaaggatcacttgaagccaggagtttgagatcaacctgggaaatgaagcaagagcccccactccatctctacaaaaaaaattaagaattagccagatgtggtgacatgaaccagtagtcccagctacttgggaggctcaagtgggaggatcacttgagcccaagagtttaagaccagcctgagcaacatggtgaaactccatctgtacaaaaaatacaaaaattagccaggcatggtggcacacacctgtggtcccagctactcaagaggctgaggagggaggatcacacgagcccaggagttcaaggctgcagtgagctatgatggtgccactgtaccctgtctaaaaaaaaaaaaagtggatccacatatacaagaagcaaaatgtatatcaaccaggaaaaggaagccaatgtatattcattatactcaaacttcagaacaataaaggcaaagatatcttaaaagcagccagaataacttatccacttttaaaggaataacgaattgacagaccttttttttttttttttttttttgagacagagtcttgctctgtcacccatgatggagtgcagtggtgtgatttctgctcactgcaacctccatttcccgggttcaattgattctcctgcctcagcctcccgagtagctgggagtacaggtgtgcgccaccacaacctggctaatttttttgtatttttagtaaagacgtgattttgccatgttggccaggctgttctcgaactcctgacttcaggtgatctacctgccttggcctcccaaaatgctgggattagaggcatgagccactgcacctggccaacagtagacttttcagtgccaaaactggaaggcaaaagacagtggaataacatcattaaggtactgagagaataactcaatagaatgagtgcccagtgaaattatctttcaaaatcaagggtatattaaaaacacttttttctcaaaatgagaatttacaaacaagggactttcacttaagaataaagatgaattttagagtacagcaaaatgactaggaggaaagtctgagatgcaagaaggtatggtgagctaaaaaatcagtaatcatgggaaatgtaaataaatactgtctatattaagaagtatttactctgtggagtaaaaaagagcgtaattaaaatactagcaacattttacataactcaggaaatgtatatgtggggaaagtgtccgggagcacttagaagttagtgtgagtgctccaagatcctgatactctttaggatggaagttaagataatgaatgactttagatgttgttaatctaagtacttaacagaaaattttcagataacctttaaagaatagcaatacaatataactttcaaaccagtagagaggaaacattctgaaataagggaaaaacactttagaaatcccaactttgatagaccacaaaaatgcaagaaggaagaaaaagcatagaaaaagcaaagaaatggcatagtatataataaatggttacaataaatataaattgcctatctcaccagattaataaaaaaaaaagtctaccttgttcaatatatacagtttacaaaagacagtacaaggacagagaaagacaaaaagtagaattagggaaaataaaacaagcaaatatacctggttaggatagctgtatcagtattagccttacaaatattaaagtgaaaagcattaataaggataaggagactctcaaaaataataaaaatttcaactgaagtaggtataacagttctaaacaaagttattaaagtaaaaatgtagagggcaaaacggaaaaaaaaactattatgttgtatttgaagtcactcaatttttagctcgagcagcaaaaaagtaaatagaacaacatggtaaccaaagttgattcaattaatacataaaggatcatgttcccccaatttagagcatgtgcatatttcttaagcatgtataaaagatttagaaggaaaatgataaaggaatgttttggggacctctgatagggaaagatttcttagaaaatctgcaaaagatattaaccataatctacataaagtcaactgttttatttcaagcctctctggaaatagttttgttgactgataagaaacgctctatgtcagtcagctaatcaatgtctagtgagtctaactctttccactacacagtaagttccatcttagggtgttttacttaaaagcctggtgtcaaatgttacacgcacaaaaacttattagtatctttttaaccaatgtatcttaggagatacggaattatttctaacacactggttgtatttactaattttccgctgagccatcataaaaatagaagtcacatcgtcactatttcttgcttgtccaacccagtgtctatggtaccctcggcagttattcatggctcctaggccttcttttagagtactgtctctcttctattggctttggatggaattgactccatcctaactgcagaaatgataggcactgctttacataaatcagtcagcctaatagcattctttttgcctcagagattggttcagagatggggaaaaacccactctaggcaatcagcttgtgacttactttcctccaattggtgatccaattagggcagtgtgtggaatgtgctgctctgtatgtgcagccagatgctcatgttcataaaaaacattttaatactgtgatggaagatacagcttcgagacaaagacacaagcttgggtagagtcattcattcatttagtaagcatttgctgagtgcttaataaatgctgggccctgagaaaaagcaaaatcttattcagcacattctgacattggggacaatgcgatagttgatagcttccacacttaattagaaacaaagattatctcttaaaacctcattcttgtatctaggaagacttttgttttcccaatcagaaattgtggttccagaaaaagaacaagacaatgaaaacattgtataaaaggtttctttcaaacttttttcaattgacagtttttcaccccaatcatcttgatgcagagaggcttcagaaacacaagtgactctgtgttcagaccaagtacttggcctcgagaagatgaatgatcagaccaactcaccatatgattataagggtcaggtagtttaaaaagaaattacaatctgaattgaaccatggatgaacagtgttgctattgagcttcgaatcccagctaataagcataaccttgtaaagagaggttactgtttgggaaactgcatgttcttgcaggagggcaaagcttttgcaatataaatagttgtaagggtactagctttcatctttaataccttaaccctctgtgtttagagtttttgtatccagggctgaattgagaattttagaaaccttgaacactgaagagattgtaataacaaccccatgtgtaatttataaaatcttcaaaagaaaatttactttttcaaaatgttataaaactctgaatactgaaatgaaaa

SEQ ID NO: 188495 - DNA, 1246 bp, Homo sapiens
  Payload ID: 17087
  Gene Symbol: STX8
  Gene Name: syntaxin 8
  Uniprot ID: Q9UNK0
  ENST ID: ENST00000306357
  CDS Start-End: 429-1139
ggtataatttacatatcataaagttaacttaaagtaggttgtagtgagtttacgcagcgtgcaagtctcaccgcaatctagtgttttgtttattgttttgtttttgaagcaggataaatttttaagtaactgctacagagaggtcttgcagcgctcccaccttcctgggaaaatgctttgtttctatttaacaattttaactgagcttagcagttcgcgtctcttggtgggagtagattgctccagtgtactgtccgcaggggagcgctttgctttctctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaaagaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggacgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaattcccccaaagctctga

SEQ ID NO: 188496 - DNA, 494 bp, Homo sapiens
  Payload ID: 17087
  Gene Symbol: STX8
  Gene Name: syntaxin 8
  ENST ID: ENST00000573016
  CDS Start-End: 157-494
agaaacccagcctgccgagttcgagttcattagcattcttggaaatgaaggggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaaagaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgag

SEQ ID NO: 188497 - DNA, 638 bp, Homo sapiens
  Payload ID: 17087
  Gene Symbol: STX8
  Gene Name: syntaxin 8
  ENST ID: ENST00000575858
  CDS Start-End: 28-162
gtccgagcggcgggcggagtctgcaggatggcaccggacccctggttctccacatacgattctacttgtcaaattgcccaagaaattgctgagaaaattcaacaacgaaatcaatatgaaagaaaaggtgaaaaggcaccaaaggtccagcctgatgagtgaagaggctaagcgaggagcacccaacccttggctctttgaggagccagaggagaccagaggcttgggttttgatgaaatccggcaacagcagcagaaaattatccaagaacaggacgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaattcccccaaagctctg

SEQ ID NO: 188498 - DNA, 731 bp, Homo sapiens
  Payload ID: 17087
  Gene Symbol: STX8
  Gene Name: syntaxin 8
  ENST ID: ENST00000574431
  CDS Start-End: 263-640
gagtccgagcggcgggcggagtctgcaggatggcaccggacccctgcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggacgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaat

SEQ ID NO: 188499 - DNA, 454 bp, Homo sapiens
  Payload ID: 17087
  Gene Symbol: STX8
  Gene Name: syntaxin 8
  ENST ID: ENST00000575294
  CDS Start-End: 4-159
aggatggcaccggacccctggttctccacatacgattctacttgtcaaattgcccaagaaattgctgagaaaattcaacaacgaaatcaatatgaaagaaaaggtgaaaaggcaccaaagaacaggacgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctgccaatgacagatgcaagcccaacacccttttggtacgc

SEQ ID NO: 188500 - DNA, 3765 bp, Homo sapiens
  Payload ID: 17088
  Gene Symbol: STXBP1
  Gene Name: syntaxin binding protein 1
  Uniprot ID: P61764
  ENST ID: ENST00000373299
  CDS Start-End: 122-1906
tccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccaggggg

SEQ ID NO: 188501 - DNA, 3967 bp, Homo sapiens
  Payload ID: 17088
  Gene Symbol: STXBP1
  Gene Name: syntaxin binding protein 1
  Uniprot ID: P61764
  ENST ID: ENST00000373302
  CDS Start-End: 198-2009
cccgcgcgcgccggcggcggggcagcctcgctctggctcgcgccgcgcccccgcgcccagtccgcgcgtcagtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccaggggg

SEQ ID NO: 188502 - DNA, 591 bp, Homo sapiens
  Payload ID: 17088
  Gene Symbol: STXBP1
  Gene Name: syntaxin binding protein 1
  ENST ID: ENST00000496504
  CDS Start-End: 1-226
aaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcgggggtaaggcagtgcaccagtctgctggagtggcctcccgtgtgtcccccaagtgaggagctggcctggactcctcctccggccttaaggttcctctgacagttgtctcaagaagatcaggatttgagcatctcttacttcaaattactcttccagtggttttgttatcttctcaatgttatagtgaaatataataatacatgcagaaaaaagcataaatcaactattgaataacgaaaatgtgaacctctatgtaactgcaactcaggctgcctaccgtttttaatttctttctaatctttaaaaacaaatactatctttactaaagatgtttcagagtaagataaaatacaaagagagtaattctccaaa

SEQ ID NO: 188503 - DNA, 563 bp, Homo sapiens
  Payload ID: 17088
  Gene Symbol: STXBP1
  Gene Name: syntaxin binding protein 1
  ENST ID: ENST00000494254
  CDS Start-End: 1-360
atcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagtaaaagcagcttattacagaaaagaaactcttccactctgaagggctttctttgattattccgtcactctttttctttatttcttcctttttagtttattatttatttgattttgtttcaacaagaaaatgcttgcagttctcaacaccgattgaaaatgtgtccagtgctgccctcacagccctg

SEQ ID NO: 188504 - DNA, 572 bp, Homo sapiens
  Payload ID: 17088
  Gene Symbol: STXBP1
  Gene Name: syntaxin binding protein 1
  ENST ID: ENST00000630492
  CDS Start-End: 265-572
agtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagagaaagaggaagactacctagacatgttgctccagagcagaatttccagcagtagattgaaccttcggaggccgagtcccagcccagtgtaaactgagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatga

SEQ ID NO: 188505 - DNA, 538 bp, Homo sapiens
  Payload ID: 17088
  Gene Symbol: STXBP1
  Gene Name: syntaxin binding protein 1
  ENST ID: ENST00000627871
  CDS Start-End: 237-538
agtcggtccctagcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttct

SEQ ID NO: 188506 - DNA, 667 bp, Homo sapiens
  Payload ID: 17088
  Gene Symbol: STXBP1
  Gene Name: syntaxin binding protein 1
  ENST ID: ENST00000626333
  CDS Start-End: 227-667
accatttcctgcaatcttgttgaacattaacttattccacctgggaaaatgcagttgtttatcaaggagacccttcagccccacacgagacattcagagaaacttggttgctgtctttgctgtcaggaaagaggaagactacctagacatgttgctccagagcagaatttccagcagtagattgaaccttcggaggccgagtcccagcccagtgtaaactgagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaag

SEQ ID NO: 188507 - DNA, 550 bp, Homo sapiens
  Payload ID: 17088
  Gene Symbol: STXBP1
  Gene Name: syntaxin binding protein 1
  ENST ID: ENST00000625363
  CDS Start-End: 103-550
agtgttggtgaatgcacgaatgcaggtacccagcgacagggaggtgctgtgggtggattcaccctggcttcgctgcggctgggagtgggcgctgctaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcaga

SEQ ID NO: 188508 - DNA, 578 bp, Homo sapiens
  Payload ID: 17088
  Gene Symbol: STXBP1
  Gene Name: syntaxin binding protein 1
  ENST ID: ENST00000626539
  CDS Start-End: 150-578
aagctcccagaaagaggaaagacaggacccgagcggggtttcaggcagatggagcgcgtcggtagcctgtggccagggatcccagcaccgacgggaaagaggaggcctgggtaccctgcgccccgggcgcgcgcggcgcgtgagagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctac

SEQ ID NO: 188509 - DNA, 1876 bp, Homo sapiens
  Payload ID: 17089
  Gene Symbol: STXBP2
  Gene Name: syntaxin binding protein 2
  Uniprot ID: Q15833
  ENST ID: ENST00000221283
  CDS Start-End: 32-1813
ccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 188510 - DNA, 1859 bp, Homo sapiens
  Payload ID: 17089
  Gene Symbol: STXBP2
  Gene Name: syntaxin binding protein 2
  Uniprot ID: Q15833
  ENST ID: ENST00000414284
  CDS Start-End: 24-1796
ggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 188511 - DNA, 1914 bp, Homo sapiens
  Payload ID: 17089
  Gene Symbol: STXBP2
  Gene Name: syntaxin binding protein 2
  Uniprot ID: Q15833
  ENST ID: ENST00000441779
  CDS Start-End: 38-1852
acacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaaggctcaggcccagagagtgatccaccttccccagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 188512 - DNA, 549 bp, Homo sapiens
  Payload ID: 17089
  Gene Symbol: STXBP2
  Gene Name: syntaxin binding protein 2
  ENST ID: ENST00000593535
  CDS Start-End: 215-549
gaagtgtgtgtctgaactcccatctgtgagcgtgtcgtcgaggtgtgcacctccagcgacttcgtgctcggcagcgcggacgcacctgcccgtcctccccgccagggactcaacttcctgggcctgggcgagaaccgacggcggggaggggccagaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggt

SEQ ID NO: 188513 - DNA, 552 bp, Homo sapiens
  Payload ID: 17089
  Gene Symbol: STXBP2
  Gene Name: syntaxin binding protein 2
  ENST ID: ENST00000595950
  CDS Start-End: 46-552
accttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgag

SEQ ID NO: 188514 - DNA, 1785 bp, Homo sapiens
  Payload ID: 17089
  Gene Symbol: STXBP2
  Gene Name: syntaxin binding protein 2
  ENST ID: ENST00000597068
  CDS Start-End: 29-1255
gaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataaggacctggccatgggctccgacgcagagggggagaagatcaaggactccatgaagctgatcgttccggtgctgctggacgcggcggtgcccgcctacgacaagatccgggtcctgctgctctacatcctccttcggaatgctacccctctggacccgggaaccctcctccattggcttggggattcctccactgaggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctga

SEQ ID NO: 188515 - DNA, 1523 bp, Homo sapiens
  Payload ID: 17089
  Gene Symbol: STXBP2
  Gene Name: syntaxin binding protein 2
  ENST ID: ENST00000599737
  CDS Start-End: 1-516
ggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccggggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccctttccag

SEQ ID NO: 188516 - DNA, 770 bp, Homo sapiens
  Payload ID: 17089
  Gene Symbol: STXBP2
  Gene Name: syntaxin binding protein 2
  ENST ID: ENST00000600702
  CDS Start-End: 1-661
cctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcaggctcctcacacatcctcaccccgacccgcttcctggatgacctgaaggcactggacaagaagctggaggacattgccctgccctgacccctggccccgccccctacccctccctttccagagaaataaactcttcccgtcgctctgcca

SEQ ID NO: 188517 - DNA, 811 bp, Homo sapiens
  Payload ID: 17089
  Gene Symbol: STXBP2
  Gene Name: syntaxin binding protein 2
  ENST ID: ENST00000599400
  CDS Start-End: 1-448
ctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctgacccctggccccgccccctacccctccct

SEQ ID NO: 188518 - DNA, 716 bp, Homo sapiens
  Payload ID: 17089
  Gene Symbol: STXBP2
  Gene Name: syntaxin binding protein 2
  ENST ID: ENST00000602355
  CDS Start-End: 330-716
ttgccttcatactttgtctcactgcttcttatctctttgcctatctctgcctctgtctttgtctttctctggctcgctctctctccctttggctttctctctccgtctctctctggctcactgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggctcctcacacatcctcaccccgacccgcttcctggatgacctgaaggcactggacaagaagctggaggacattgccctgccctga

SEQ ID NO: 188519 - DNA, 1188 bp, Homo sapiens
  Payload ID: 17089
  Gene Symbol: STXBP2
  Gene Name: syntaxin binding protein 2
  ENST ID: ENST00000612033
  CDS Start-End: 1-1188
tgcatgcgtgtacatgtgcatgtgtgcatgtgtgtgcatgtgtgtgtgcatctgtgtatgcatgtgtgtgcgtgcatgtgtgtctatgtatgtgtctgtgtgcatgtgcatgtgtgtgcgtctgtgtgtgcatttgtgtgtatgtgtgtatgcgtgtgtgtctgtgggtctgtgtgtgcatttgtgtctgtgcatgtgtgtatgcgtgtgtattgtgtgtgcatctgtgtgcatctgtatgtgtgtgtgtgcgtctgtctgtgtgcatgtgtgtatgcgtgtgtatgtatgtgtctgcgtctgtgtgtgcgtctgtgtgtatctgtgtgtgcatgtgtgtatgcgtgtatatgtatgtgcatctgtgtgcatgtgtctatgtatgtgtgtgcatctgtgtgtgcgtgtgtatgcgtgtgtgtatgcgtctgtcatgtgtgtatgcgtgtgtgtgcgcatcagtgtctgcatgtgtgtatatgtgtgtatgtatgttgcgcgcgcatctgtgtgtgtgcatgtgtgtatgtatgtgtgtgcatctctgtgtgtgcatgtgtgtatgtgtgtgtgcatctgtgtgtgtgtgcatgtgtgcatgcgtgtgtatgtgtgtgtgcgtgcgtgcatctgtgtgtgtgcgcgtgtgcccatgtgggtgcgacactagtgtgcatttgcacatatacatgtccccgtccgtccatgtttgcacatggtggcagatggggggtggctgggaggcctaggcagccaatgagcctaggtgtgcaggctcaggcccagagagtgatccaccttccccagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtacggcccgggctcatcctgggcagggggtgggggtttgtgaccaaatgtcccctgttccctcagaaacagacactgaggctgggcgcagtggctcatacctgtaatcccagcgctgtgggaggccagggcaggaggatcacttggggccaggagtttgagaccagcctgggtacagagcaagaccccgtctcttaa

SEQ ID NO: 188520 - DNA, 1892 bp, Homo sapiens
  Payload ID: 17089
  Gene Symbol: STXBP2
  Gene Name: syntaxin binding protein 2
  ENST ID: ENST00000622853
  CDS Start-End: 50-1789
ccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcccagtctggaggccatttatttgctgagccccacggagaagtcggttcaggccctgatcaaagacttccaggggaccccgactttcacctacaaagcggcccatatcttcttcaccgacacctgccccgagcccctgttcagtgagctaggccgctctcgtctggcaaaggtggtgaagacgttgaaggagattcaccttgccttcctcccctacgaggcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagggcccagaggacacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcacgttccaggccatggcgtatgatctgctggacatagagcaggacacatacaggtatgagaccaccgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgaaaaagatgccgcagtaccagaaggagctgaataagtattctacgcacctgcatctagcagatgattgtatgaagcacttcaagggctcggtggagaagctgtgtagtgtggagcaggacctggccatgggctccgacgcagagggggagaagatcaaggactccatgaagctgatcgttccggtgctgctggacgcggcggtgcccgcctacgacaagatccgggtcctgctgctctacatcctccttcggaatggtgtgagtgaggagaacctggccaagctgatccagcatgccaatgtacaggcgcacagcagcctcatccgtaacctggagcagctgggaggcactgtcaccaaccccgggggctcggggacctccagccggctggagccgagagaacgcatggagcccacctatcagctgtcccgctggaccccggtcatcaaggatgtaatggaggacgccgtggaggaccggctggacaggaacctgtggcccttcgtatccgaccccgcccccacggccagctcccaggccgctgtcagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcagtgggaggtgctcattggctcctcacacatcctcaccccgacccgcttcctggatgacctgaaggcactggacaagaagctggaggacattgccctgccctgacccctggccccgccccctacccctccctttccagagaaataaactcttcccgtcgctctgcc

SEQ ID NO: 188521 - DNA, 2478 bp, Homo sapiens
  Payload ID: 17090
  Gene Symbol: STXBP3
  Gene Name: syntaxin binding protein 3
  Uniprot ID: O00186
  ENST ID: ENST00000370008
  CDS Start-End: 51-1829
agtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaatta

SEQ ID NO: 188522 - DNA, 15590 bp, Homo sapiens
  Payload ID: 17091
  Gene Symbol: STXBP4
  Gene Name: syntaxin binding protein 4
  Uniprot ID: Q6ZWJ1
  ENST ID: ENST00000376352
  CDS Start-End: 208-1869
aggtggcagcgcttgcagtcgggctacggaggccgggttgccagattacgggaaagccatttaagaagttcctggaataatattagtcagagtaatataggatctgcaggaagtgtctcaagatagttggaaaagaagaatttctagactcttcatcaagatcttcatttatacagctgttaaatccaaggctactttggtgaaagcatgaataaaaatacatctactgtagtatcacccagtctacttgaaaaggatcctgcctttcagatgattacaattgccaaggaaacaggccttggcctgaaggtactaggaggaattaaccggaatgaaggcccattggtatatattcaggaaattattcctggaggagactgttataaggatggtcgtttgaagccaggagatcaacttgtctcagtcaacaaggaatctatgattggtgtatcatttgaagaagcaaaaagcataattaccggagccaagttgaggttagaatctgcttgggagatagcattcataagacaaaaatccgacaacattcagccagaaaatctgtcatgtacatcacttatagaagcttcaggagaatatggacctcaagcctcaacattaagtcttttttcttctcctcctgaaatactaatcccaaagacctcatccactcccaaaacaaataatgacattttatcttcttgtgagataaaaactggatacaacaaaacagtacagattccaattacttcagaaaacagtactgtgggtttgtctaatacagatgttgcttctgcctggactgaaaattatgggctacaagaaaagatctccctaaatccctctgttcgctttaaggcagagaaactggaaatggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaaggaaaaattattggaatcagataagcaaaggaaacaattgacagaagagctccagaatgtgaaacaagaagccaaagctgtagttgaagaaacaagagccctgcgtagtcggattcatcttgctgaagctgctcagagacaggcacatggaatggaaatggactatgaagaagtgatccgtctgttagaggccaagattacagagctaaaggctcagcttgctgattattctgaccaaaataaagaaagtgttcaggatttaaaaaagagaatcatggtactcgactgccaattacgaaaatcagaaatggctcgaaaaacttttgaggcatccactgaaaagcttcttcattttgtagaggctattcaagaagtattttctgataattctactcctttatcaaatttaagtgaaagaagagctgtgttagcttctcagacttccctcacaccactgggaaggaatggacgtagcatcccagcaacgctggcgcttgaatctaaggaacttgttaaatctgttcgtgccttacttgatatggattgtttaccttatgggtgggaggaagcttacacagcagatggaatcaagtacttcatcaatcatgtaacacagactacatcctggatccatcccgtgatgagtgtcctgaatctatctcgctcagaggagaatgaagaggattgctctagagaactccccaaccagaaaagttgatggttttccttaggaagtggagctacatggatgatgtgagcagagacgcataacatccaattctgagatgaaacagtctaaaataggagtaaagcatgcactacttgttgaagtgtgaaatggagactctggactttgggtatttttgtaaaacttttgatatttctgtatacatttaaaaaatcaattgccactacagtagttccttaagaataatctagttatattttttgaaatcacatataattagactttataatatatatactttttcatatataattagatctttctttgtaatttcatatgtagttcttcatagggtctcagatacaatggtttttataattgacatattgaaaaagtatatgaacataatgaaacacctcatttatttgataattcactaatgttttatattcatatattaggaaagtgaacttagcaagctttttggaatttaaggatcacatttagacatctcatgggctgatgaatacagctggtatctttgtggagctttctaatttacaaaatgctttgtagaccccattgtctttaaaccatacaacatgcccgtgaagctgatctggtgggtatgtttattcttggttttcagtagggaaatagcagttcagagagaggaagctctctgtcccagcaccgagactcactcctaagtcttctgattccatgagcagtcccccttcccccataccctgctgtctccacggagggaggtcacagcccatcacgcaggacactgtgattgtgttgatgcagctggctccacagctgtgcattccacagagattcagaaggcacctcttcggtcaaacatggcccctctataaccccactattcttctcctataaacccttcccccttctctgcacccaagccttcgccaagtaggcgcactctttgtgatattgtttcagcagacttctttcagcagctcgtgtttttctaaagtgaaaggcatggtttgtcctgcttaggttgcccttcccagagggatggtttgaggggagctgatgagaagagaggtatctgttaaaacattactgctctactcgaaacaagatggaagcctaaagcccaagtcgagcagctcccagcactgctgtgcagacctagaggtccttagaacatagtctaagaaccattcattgtagccattttatagttgagtaaactgagatcttaagtctcctagtctactgaatttcatatggtgtataatacagatttatatggtaaagatatacatatacattgtgctcaactatacattcctgaatccatttaggatttgtgatttatgtcttgagtaataatataaagtcaactccagactgataggtagtcattagccatgagaaatgtttcaggatggctagggaagacttgtgttttgcctgacagccatttgaatgttaggaagcttcggggagacaagttttgagagaagccccagagggagctatttccttgcaccccccagaggtgaatgaggtattctataagttagtgtctataattgtgaaagtacaaacttcttgtttttgtcaaattaatggtatgaaatttctctccccctgcttgaagagttttctaattcgtttctagtgagcaaaacaaagaaggtgcttgagtcactgaaatcaaagtactcaggcacacagcccactgacaagagacacctcatccattaactgctgttttgtaccacttgccgccctgtttctgtcaaatacctagtgaaaaaggcctaaacaattgtaatgatattatttattgggcattttgtgccatacatggtgatgagcagtttgcatatatttatttatgatcttcttaaaaccattccatgaaataggaactgtaattatccccaattctaaaagaaaaaacttagttttagagagttagtaatctttgcctaagggtcacaaagcacctatgtgtagaagctagggttcaaggcagatctgtgattccagaagctgttctctaaaccactatggagaactgcttagattcattgtctatgggtacattttataaaaaggcagattctagttcagtgtcataaggaactttctagtaattagagctgataagaaaagaattccccaggagaaaatggaaacactatcccagcaatctgaattccttacttggggaatgttgctgaggaggttcagtgtgtgaatggactgaaccagttggccactctctcagattccctcttcataaagcttccgtgacttctaaaccatcaggtcggtgccataagagatgctcaaaaaagcatggtcagggcttagcaagaatccttttccagtgcaaatacgaccctcatattatgttttggcgagtagccagtctttctttaacatcaatcaaccgtagcaatgtggtcatcacgaagtcttcattgactcactggcttggattttagggttagaaaatctgaatgttcttatgtccttccgtctcactttactagagtgcccaagttgactcatccttactcactcattccctcaaaatatttattgagcaccaacaatgtcacaagcactgtgctaaacactgtggtgaagtagaacaattgctaatcatttcctgggttccacttactcttgatttaaaaaaaaaaaaacaacaaaagagtttgtgtgtggccaggactaaacagctgcttcttaatttttgaattttaaaactaatctattttatttaaaaaaaatcaagtactttggaagtgaataaagtaagagatagcctgtctcactttccagaggtagcagtcactaatactgtggtgagtgattttactcaaaggaaatcacactattaagcagcttggttttgacatgttatgttgtggtcatcttttcatgtcaatacatagattaatcttttatttcaaatgtctacataaaatatcactacccacataacctataatttgtgtggccagcaatttattgaacactaaaatgttttaagttttcttattgctaacaatgtcacagtgaacatttatatattcattaaatccttttcctcatgtatctttgcactcttgtgctagtatgtctatagtgtgaatacattcataaatttcttgatcaaagctaggtcaaagttacattcattttaattttggtacatatccataaattctccataaaagtaggaccaacttacattaccaccaatagtgtatgtgagccttatttttatgtatgataggactttttttagtccaaatgttcctatagattttctgggttttttttttttttttgtccttggaagaataaccttccttccaccaagtccaagaacctgagatttttaatcattaggttttagatttcctttagcagcagagactgacttgctgtatagagggaagtcaagtagtgactaactcactatatgtcaaacacatcattactcttctcttttcctactttacatgtaatggttgcgaggaccaactttcaaatgagctaacttgggtgagacgttcactaaagtaccaagcacaatacaaatgcatcttcgagttctttgggcctcactttccctatctgaataataaggatagtaatcccttgccttttctcaaaccagttcaactcagcaaacacttcctgagcacctgctacatgccaggcaaaatgtgaaatttgcatgctatgaggctaaatggtactgattctcaaaacaaggagctcatagtctaaaaccatttttctttcttttttttccccctaaacaacctcttaaaggggtaagaagttagggggttgtttattaagaacccctgaagagcaaccctttaccactctcttaaatttgaaaaattccaaaataatattaacacctcttgactagaaaaggaaaaaaaaggaacatgccgtatgaagagcctctccaataataaatgcaaagcagctgtcaaaatatagagtcaagtgatactttcataaagtgtttgcacaattagaaaatgttatcctttttctcgggagaaatgggacatttttattttctctgctaagtgaaatgcaactttttgaagaatcaacacgcttgacatttttacaatgtacataaagaactgaactattattaaaacaacttacacactccattgcttataacttttgagagaatgaaaagaaccttaaacagaatgtgcctgtggagcttcgctttagaaatgaaatacccaaggtgttttaactacaactgtctacatgtaatagtgtgtctgcataatgactttgtaaatattaactgcaattctgtatttgctttcttgatatgacttttaacatttaaacttatactgtttctgtctacttttttcaaaagttcaatttttacttttgggggttggactgttctgagggaaagggcgatcagatcaatagttctgtcccccattccattcccccatcacccaattattctctatatcactctaccctgtttatttctttttttttttttttttttttttgagacggagtctcgctctgtcgcccaggcgggactgcggactgcagcggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcctatttcttttacattatttatcagtttgccctaaccttgttttgtttgttatcttcctcaatagtgggagtaataatgggagtcagcttcgtgagggcagggattttgtcttcttgtattcatttactcacttacacacttaccgagagctactagaggccagacacttcactgagtagtagggatacaatgtgagatatatgtgtttctagcccttgtgtaattcgtattctatgcaaaggatatacgattgaaattaaccaaaactttttccatttattttctttctccgcattctttatcagatatttgaactactggaccatttaatgttcattacgttaacaaagagtgtgatatcagaaagcagaaaaaagcatgttcttttgcatttcaaaaatttagctccttggggaactagaaaggatttatgatttaggtcaaagatttgagagcacatatgatgaggaagatgaggctttcttactcactgtctaggaaataattctcctggctgtgagaaggagaaaaaagaacaaaaatgttggtagggcacagagaaggacctgggcttaaccttctggaccaagttccagggagcagcaaaacctcaattacatttgtcccctagaatggaaatgattatgtggtatgtttaggcagtgggaccttggacaacgccagtgagcttcctccagcccaatgtggtcaacattggaggattagattgatttctgtgaacccaaaaggatcacaggagtagcaataacacctgctggacctgaatgaggatcttttccattcaatccacatgttctctcaatggaaatcaattcggacaataacattagaccatcttaacccagagtgccttagcactagataagcctctgctgtggtctggatgtttgtgcccagcccctaatttcatatattgaaacctaacccccaaggtaccagtattaagaggtacggctctgaggaggtgattaggtcatgaggctccatcctggtgaatgggattaggacccttatgaaagaggcttcagggaacctgtttgccccttctgccttgtgaggatgcagcaagaagttgccatctttgaagcagagagcaagccctcaccagaagctaaatctgctggcatcttgatcgtacacttcccagcctccagagctgtgaacaatacatttatattgtttataaattacccagtctgagatattttgttatagcagctcctgaatggactaagacagcccacagagtttagcagtgaccccaaggaaaggaaagaactgcaagttgcctgagattaatgttgctcaggatccatttattccctattcctggtgtttctttgtagagagtgctccattaaagtaacacttttgtcctgtctctgcttcttccttaggcagcgatttacctaattggtgagtttaggattaaaaaaaggaatacatcctagaacatttcttaaatatattcccttttctctgtttcatgcaaacatggcttatttatttttcaagtctttctcatttcttacctggatgctttcaacacaggtgatatagcttcttccttctccaccacacctgtccccatcaatctacccatcacatttctgtcagaattatctttctataacacaaaattgcttctattcctcccttgctagtcttcagtagttccctagcaccttctactatctgagtccctggctttctccctagcctcatgtcttatcaccaacagttgctcagatatactgttttctgtctaggaaacttctcttgccccattcctgcatcagatttcttctcatacatcaagattctgctctcattttacctcttctttgaagagctccttgacacatgctgccttccccatgcccagagctggcactctatggatgccatgcctgcatttttacacacctgcccaaccccacttcccactcaggagtggtagagcaagaacttccacctcaagagagttgctggcctgtttgtccggacactcatttggttactatatttactaatttacttttatctactgagctgggttactgagtcttagaggcttgaaatctggttctaccttctctttctccatgtggtaatgaaaaccggaactctggttaaagctaagtggtctctctcactgtggctgttccactcaacatcagtagctaggtgagtaaatcaggtggaggtgggaaggaaatgggaaaacagaatactggccaggatggtctgttgtttcttatctgttgttggctttggggtattttattctaaaaccctagaggctgagaaggttaactggaaggcttccaactctgaaatcctaccgcagtcccctattgctgcataccttttaataaagtatcaatcacactatatatgtaattaatttggataggaaagtagggcatgtgtcatctctcctagtagactgtgagtcctttattactgactcagagtccatatattattttttatttctcatgcaagacatgacacagtaaaatctaataaaagtttacaaaataaatttaaaatgtaacattaacataaaaaactcttttagctgtttcctgcttctggcagggaaacaaagattgaattaagaaggaaatgaggtgggggtttaagtaagcatgtctgtactaactagttccactaatgtgggaacaatataatggattttgctgaagaaggaagtgtatgctacttaagttgggccataaaactcacagtatgatcgcagtaaaaggattgtaaagcacatactcacacattgttgatttgcccaaggttctgaagaaataccacagaatgattttggtatagaagggtagataaagcctgaaaccaaaatacaaggttagtgcatttcagagcagcagcaaacttctgttcttatgggttaattaatcatgttactgaagaattgatttggcacaagggagctatgtattgccacagaactctgaaattgcagaaattatctcatctataagtaaccccactggaattgcttgactgttctgtttcacagtggagaaattcatctttcatcagcacacacgagaagagacaacaggaagacaaaacaaattgagtagataataaagttaccttataggaataggtaatatagacaggtaaggtcagaaatttctgtggaatggaatatgaaaagatgtttatgagcagattctatttctttaggcagttttatcattcagagaagtaatctatgcatttaatctaatgccagcttttatttttctttggtgattaccacacaaaaataagaagttggcaccaaattaaatgcatggattacttctctgataaaagtactcgatataagggaaatttgaaggaaatagaatgcatacatacacacacatacacttagtatatgtgtgtgtgtgtgtgtgtatatatatatatctgtgtgtatatacacaccacacacacacacacacacacgtattggaggaataagaaatatttaataaaatctacacaatttcaaaaatatgaccaaatactggtggttcctcatttaccagtagaactctctctacaaatggaaagtgagaagtctatgaagttaccttagtttttccaattaagactgttcattgattgtatttcttctgtctctataagtaccatattcccaattagtatttcatcagttataagacccatcattattttgtgtgtaactgaaaatgaaaaaaagatttaaaatatgacttagtagttagaatttttatcttatacgcctttaagtaaatacaagagaactgtttcagcatagatttttaaaaatcatgtgtgtaaaagagaatgaaatattaattatgatatttacaaagctctgtacattcagaattgaactctttctgcatctcttttttgaatcagagttgtcataaaccacaatttttcacggtaacaccctctctgccatcaggataaataacatttcttaaaggaatattctactgcagtctctgagatttttttccctgtcttagacatccattctacaactctgatgctggcacattttttatcttggcaaaaggacttaatagaaaaattttagataacaatcaggattcatactcttctcaatagtccttaaatggtttattgaccaaaaagtaaagaagtaacagtccagtcatatcatggaaagaacaaccaaattcatgcatgcacaggcaaagacaaccatatcactatgaccacctggctgacagtaactgcaggacatcaattattgtaagacacttcctgtaatatgtttaattcctctgacataaggatttatgtgaattaggaagtggcccaagggtgaaaagtaatagggaaatagagaaatagaaccgatccaaaggaaagggggaaaaaaacccacaaaaagtgtgatgtcaagcaaagcctattctggagatgactttggttcactcccacgggagagccctagagacaaaaaggttctacagtaggttcaagtcagaggccagagaacccagagtatttatacctctgcaccatcagttattgaatgggggtgggggtgggggtgggtgtaaatttccaggtgcttccagcctgcaatgcagtcaaagcatgttcctgtagcctgaggacagccgtccaacaaagaggtgcaggtgctgaatgttgagagtgaaagcacagggagctgtcatgcatgagagtggtagagggatctgaaagtgctagcagtgcctattatacatccaaatactaaagacgcttagatgtgaaaaatgtgtgtcttagaatcgataaaatatggtatagagaatcaagtctccttgttcctggtttatctcatagcatacttaaaattcagctaaagatgaaatgccttaacaagtgaaatgggctttctgaaaaattatttcaatcaaaattgtgttaaaagctatttctaaaaaccctaacatgaaatacttagaagagatcaagtggtttgtccctggacattcaagcaattgaatgtctaaacaatccaagacagataattttgtagtatttactgtgtgaagtgaacctttaaggctgtggacaatgcaaactccctcatgtaccttgctccttgccaatttcaaacaaaccttctcacctatgatataaggcttccttagaattattgattaattatttaagatacaataaaaccaaagtatttttaaaacacagtaattatgttagtgcaggtacatgacatagatatcctcaaatattcttaggacatctataaatcaccacaaacattctggaaagcagtcttggaacatctatcaaaggccttaaaaatttcttcttctgtgaatttatcctcacaaatgaccccaagtttagaccaaaataaaaaaatgcttaaaaggcttattaaagcatgatttaaaatagaaatgattgcctaaattcctgaaaacaggggaatgtctaaataaaatatggtatctaacatgatagaaaatgtttactaatgtttaatgataccaagaaagtatcacaataataacatcaagtggtaataacaggaaacagatctgtatacaatataaaaccaacagtattgtatatataaacaccatagaagatctgaaaaaaaattagatgacattatttgtgatatctattttatttattatatttttctgcatactactctacagtgagcctgtcctttataagaaaaaatgctaatgatttattgtgtatgaaaaaagtgtatctgatttgattatatatttttatttccacttatattttctaggattattttgctttagaattctatgtataatcctgtgaaaatttgtagtgttgtagggactggaaagatcagagattatgttatggccatgaatgaggcctgacctgcattgtcaataactaaattgattattgtggaaacaacaaaaaaattcattttttgaaatgaaaatctttattgaaataactattttaccattgtgtggtcagattcactgcatttgatgctttttcaggatttgtttttcctgctagaaatgctagagttgtcacagatgtgatatttatgttttcattgtctggggagggccaagtttcatgacagagaaagactggggccaattctgtgattatggatgtcaacttatctcagagcagtatcattggttgagcagtcctgcaggacatctaagtttaccgtctttatcttgccattgtcaaagatcctggacctatttttttctgccttgaaaacttttgtgcagtaaaaccagcaatggattttagcagagttgatgcatcattaggattttcacattaactctttggacttagagccatgtctaaagtgtccttcttttggatatagtgcctggtgcagaactctaccacaaaacatcaggtgtgcctctgaatagtctttgcaagaagcacaaaatcctagaattgaggtgaatttgtaagttcctctagtccaaccacctttcaaatgaaagaatccttccaaagcacccctggccaatagctcatcaagattttgcttagatattcttattgagggggaacttactaactcctttaattcttattttgcttaaggctgagtttttaaaacatctaacatcagccaagattattgatttatctataaggaataatctgtgaattaaccttctgtagcttttccttgctgaccagggaatacctccccattgaagcctaggccagattccagtccgttttgaccataccccatcatggtattttagagtacacctgaataagatacatggtgccatgtacatggaaactgactgctctcatgttacgggttgaactgtgtccccccaaaatttgtatgttgaagtcctaaaattggcactgttgccataagccagggaactacctaggagatgctaggagagaggcctagaatggaaccctccctcccccgcccctggggccttcagagggagcggtgcccagctgacaccttgaccttggacttctagcctccaaactgtgagacaatacatttctgttgcttaagccactcagttagtgtgctttattttggcagtcttagcaaactaatacatcccccaatccagaactgtcctcctttggataataaaaacagcaataattatagtgtcattaccctgagtgactggtcccactgttggtcattctttgtagatgtgagttattgccctattgagatcagaagtcctctcacttagaggcatatctaagacttttttcttgtggagggagctcactcaactgtaggtaaggtttgactcatctgggttagtagtaagaacaaacttccaagtggcaccatcttaaaggtgcaagcccatgtgggcgatgaccaggtctggtatattaagaggctcttggtagcacattagaaacacctggagagattttaaaatttacaaagcctagccaaaccccagacccattaaccctgactctctgagaataggaccctggcacctgtgttttaaggattctaggtgatttcaatgtgtagccaaggttcactgccatagcctgtcctggaatgcaggtaactaaaacttcagcagattatgaaaaacaaaagttactttcttggatgcatatattcttatagcctcaaaactgaaactgcaaactgaacaatgctgcagtcagatacacacacatatttcaactgcataacttcctttaataatacttttatttttccaaatttgaagactgtccctaagtcatttcttctaaaagttagtaataatcccaccaactcacatttacatagaagttacagtttaaagtttgcatctcgtaataacttggtgagatagggcaagcattatttctaatttgcatatgagaaaaaactaaggctcggatgagttatgtgacttccctgagtcatgttagagtaactaactcctgatttgtaaactgaaggtcccaaatcctgggaactccctcagctctgggcaagccaggacaggtaggtcaccctgcacctacacaaggactgagctgagttctagttacctgctgtgaaggactgtagaggttatctaagccagctcctccttttactggaaaaggaaaagactgagataagtttccaaaacccctgctggagcaccttctacttctagaaagatgttgaggggcttccagggcacaaaggaaagagaagtaactgtgtctccttccccaaccatgtatgtgatacattcattctctaggattggaaattcccagaaagctgtgtcagcaatgagatttgtttcattgttttgccttgttttgtcattgagttgttatagttaaagtttattattttttaatgcagaaaaaagtgacttttgggggagtgcagagttctatgaatttttaacacatgtctagttatttgaccacaaccgtaatcaagatacagaacagttttatcatttcaagtgctctcctgctatgcttttataacacacccttccccaccccaactcctggcaattactgctctattctccgtaactgtagttttgccttttcgagaatatcatataaataatcatgtattatgtaacattctgagacaggcttctttcacccagcataatgcctttgagattcatccagatcgttgtgtgtatcagtagtttgtttttattactgggttatagttcattgtatggatataccacagtttctttagccattcacccactgaaagtcatttgggttgtttctaggctttggtgattatgaataaagctgctatcaacatcca

SEQ ID NO: 188523 - DNA, 2160 bp, Homo sapiens
  Payload ID: 17091
  Gene Symbol: STXBP4
  Gene Name: syntaxin binding protein 4
  Uniprot ID: Q6ZWJ1
  ENST ID: ENST00000398391
  CDS Start-End: 276-1013
ggccgggttgccagattacgggaaagccatttaagaagttcctggaataatattagtcagagtaatataggatctgcaggaagtgtctcaagatagttggaaaagaagaatttctagactcttcatcaagatcttcatttatacagctgttaaatccaaggctactttggtgaaagcatgaataaaaatacatctactgtagtatcacccagtctacttgaaaagatggtcgtttgaagccaggagatcaacttgtctcagtcaacaaggaatctatgattggtgtatcatttgaagaagcaaaaagcataattaccggagccaagttgagtactaggttagaatctgcttgggagatagcattcataagacaaaaatccgacaacattcagccagaaaatctgtcatgtacatcacttatagaagcttcaggagaatatggacctcaagcctcaacattaagtcttttttcttctcctcctgaaatactaatcccaaagacctcatccactcccaaaacaaataatgacattttatcttcttgtgagataaaaactggatacaacaaaacagtacagattccaattacttcagaaaacagtactgtgggtttgtctaatacagatgttgcttctgcctggactgaaaattatgggctacaagaaaagatctccctaaatccctctgttcgctttaaggcagagaaactggaaatggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaagtggccagggcagaattagatgaagagccaataaagcaagtcgtggcaattttggatcctgtgagttctttgggaaatacattttttttcatgtgcagggctattcttaagggacatcatgttttgctaacgtaatttggaattaatattattttagagaggaaaaaaacacacatatcccaaatatactgtaacatttttcttctctttttttgtttgtttggttttttgattcttgtttttgttttgtgtttttgagacagggtcgcactctgtcgcccaggctggagtgcaatactgcaatcacgtctcactgcagcctcaacctcctgggttcaagtgattctcccacctcaacctcccaagtaactgggacaacatgtccatgccaccatgctcaactaatttttttttaaatttttattttgtagagatggtgtctcactattttgttcagactggtctcaaacacctgggctcaaatgacccacctacctcagcctctcaaagtgctgggattacaggtgtgagccaccatgtctggccttgattctctttatgtggtttcattctgtttttagaagaatattacatttaaattatatcctaatttttatagaaagctatattttccaaatctttaggaaaagcaacataactacttgatttaccactaattcgtcataggcacatatttttaaaattattttattaaataaggtatagtatattgataattatttaatttttattaaatagaaaatatttacaccaaaaggaaagaaaatttgttttgctaccttagtttttataatctcaacctctagaggaagccattgttgcaaatatattatttatcttttcatagatttttctctacacagaaaattatattttttaaaaataggcagggcatgatggctgacacctttaatcgcagtactttgggaggctgaggcaagaggattacttgagctcaggagtttaacatcagcctgggcaacatagcaggaccccatctctactatttaaaacataaaaacaaaaataaataaatatatgtatatgtggggacagggagtatgtgagaaatttctgtactttcccttcaattttgctatgaatccaaaactgcttcaaaaaataataaagccttaaaaaatttt

SEQ ID NO: 188524 - DNA, 2229 bp, Homo sapiens
  Payload ID: 17091
  Gene Symbol: STXBP4
  Gene Name: syntaxin binding protein 4
  ENST ID: ENST00000405898
  CDS Start-End: 120-1082
gcttgcagtcgggctacggaggccgggttgccagattacgggaaaagaagaatttctagactcttcatcaagatcttcatttatacagctgttaaatccaaggctactttggtgaaagcatgaataaaaatacatctactgtagtatcacccagtctacttgaaaaggatcctgcctttcagatgattacaattgccaaggaaacaggccttggcctgaaggtactaggaggaattaaccggaatgaaggcccattggtatatattcaggaaattattcctggaggagactgttataaggatggtcgtttgaagccaggagatcaacttgtctcagtcaacaaggaatctatgattggtgtatcatttgaagaagcaaaaagcataattaccggagccaagttgaggttagaatctgcttgggagatagcattcataagacaaaaatccgacaacattcagccagaaaatctgtcatgtacatcacttatagaagcttcaggagaatatggacctcaagcctcaacattaagtcttttttcttctcctcctgaaatactaatcccaaagacctcatccactcccaaaacaaataatgacattttatcttcttgtgagataaaaactggatacaacaaaacagtacagattccaattacttcagaaaacagtactgtgggtttgtctaatacagatgttgcttctgcctggactgaaaattatgggctacaagaaaagatctccctaaatccctctgttcgctttaaggcagagaaactggaaatggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaagtggccagggcagaattagatgaagagccaataaagcaagtcgtggcaattttggatcctgtgagttctttgggaaatacattttttttcatgtgcagggctattcttaagggacatcatgttttgctaacgtaatttggaattaatattattttagagaggaaaaaaacacacatatcccaaatatactgtaacatttttcttctctttttttgtttgtttggttttttgattcttgtttttgttttgtgtttttgagacagggtcgcactctgtcgcccaggctggagtgcaatactgcaatcacgtctcactgcagcctcaacctcctgggttcaagtgattctcccacctcaacctcccaagtaactgggacaacatgtccatgccaccatgctcaactaatttttttttaaatttttattttgtagagatggtgtctcactattttgttcagactggtctcaaacacctgggctcaaatgacccacctacctcagcctctcaaagtgctgggattacaggtgtgagccaccatgtctggccttgattctctttatgtggtttcattctgtttttagaagaatattacatttaaattatatcctaatttttatagaaagctatattttccaaatctttaggaaaagcaacataactacttgatttaccactaattcgtcataggcacatatttttaaaattattttattaaataaggtatagtatattgataattatttaatttttattaaatagaaaatatttacaccaaaaggaaagaaaatttgttttgctaccttagtttttataatctcaacctctagaggaagccattgttgcaaatatattatttatcttttcatagatttttctctacacagaaaattatattttttaaaaataggcagggcatgatggctgacacctttaatcgcagtactttgggaggctgaggcaagaggattacttgagctcaggagtttaacatcagcctgggcaacatagcaggaccccatctctactatttaaaacataaaaacaaaaataaataaatatatgtatatgtggggacagggagtatgtgagaaatttctgtactttcccttcaattttgctatgaatccaaaactgcttcaaaaaataataaagccttaaaaaatttt

SEQ ID NO: 188525 - DNA, 2807 bp, Homo sapiens
  Payload ID: 17091
  Gene Symbol: STXBP4
  Gene Name: syntaxin binding protein 4
  ENST ID: ENST00000434978
  CDS Start-End: 197-1792
cttgcagtcgggctacggaggccgggttgccagattacgggaaagccatttaagaagttcctggaataatattagtcagagtaatataggatctgcaggaagtgtctcaagatagttggaaaagaagaatttctagactcttcatcaagatcttcatttatacagctgttaaatccaaggctactttggtgaaagcatgaataaaaatacatctactgtagtatcacccagtctacttgaaaaggatcctgcctttcagatgattacaattgccaaggaaacaggccttggcctgaaggtactaggaggaattaaccggaatgaaggcccattggtatatattcaggaaattattcctggaggagactgttataaggatggtcgtttgaagccaggagatcaacttgtctcagtcaacaaggaatctatgattggtgtatcatttgaagaagcaaaaagcataattaccggagccaagttgaggttagaatctgcttgggagatagcattcataagacaaaaatccgacaacattcagccagaaaatctgtcatgtacatcacttatagaagcttcaggagaatatggacctcaagcctcaacattaagtcttttttcttctcctcctgaaatactaatcccaaagacctcatccactcccaaaacaaataatgacattttatcttcttgtgagataaaaactggatacaacaaaacagtacagattccaattacttcagaaaacagtactgtgggtttgtctaatacagatgttgcttctgcctggactgaaaattatgggctacaagaaaagatctccctaaatccctctgttcgctttaaggcagagaaactggaaatggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaaggaagccaaagctgtagttgaagaaacaagagccctgcgtagtcggattcatcttgctgaagctgctcagagacaggcacatggaatggaaatggactatgaagaagtgatccgtctgttagaggccaagattacagagctaaaggctcagcttgctgattattctgaccaaaataaagaaagtgttcaggatttaaaaaagagaatcatggtactcgactgccaattacgaaaatcagaaatggctcgaaaaacttttgaggcatccactgaaaagcttcttcattttgtagaggctattcaagaagtattttctgataattctactcctttatcaaatttaagtgaaagaagagctgtgttagcttctcagacttccctcacaccactgggaaggaatggacgtagcatcccagcaacgctggcgcttgaatctaaggaacttgttaaatctgttcgtgccttacttgatatggattgtttaccttatgggtgggaggaagcttacacagcagatggaatcaagtacttcatcaatcatgtaacacagactacatcctggatccatcccgtgatgagtgtcctgaatctatctcgctcagaggagaatgaagaggattgctctagagaactccccaaccagaaaagttgatggttttccttaggaagtggagctacatggatgatgtgagcagagacgcataacatccaattctgagatgaaacagtctaaaataggagtaaagcatgcactacttgttgaagtgtgaaatggagactctggactttgggtatttttgtaaaacttttgatatttctgtatacatttaaaaaatcaattgccactacagtagttccttaagaataatctagttatattttttgaaatcacatataattagactttataatatatatactttttcatatataattagatctttctttgtaatttcatatgtagttcttcatagggtctcagatacaatggtttttataattgacatattgaaaaagtatatgaacataatgaaacacctcatttatttgataattcactaatgttttatattcatatattaggaaagtgaacttagcaagctttttggaatttaaggatcacatttagacatctcatgggctgatgaatacagctggtatctttgtggagctttctaatttacaaaatgctttgtagaccccattgtctttaaaccatacaacatgcccgtgaagctgatctggtgggtatgtttattcttggttttcagtagggaaatagcagttcagagagaggaagctctctgtcccagcaccgagactcactcctaagtcttctgattccatgagcagtcccccttcccccataccctgctgtctccacggagggaggtcacagcccatcacgcaggacactgtgattgtgttgatgcagctggctccacagctgtgcattccacagagattcagaaggcacctcttcggtcaaacatggcccctctataaccccactattcttctcctataaacccttcccccttctctgcacccaagccttcgccaagtaggcgcactctttgtgatattgtttcagcagacttctttcagcagctcgtgtttttctaaagtgaaaggcatggtttgtcctgcttaggttgcccttccca

SEQ ID NO: 188526 - DNA, 423 bp, Homo sapiens
  Payload ID: 17091
  Gene Symbol: STXBP4
  Gene Name: syntaxin binding protein 4
  ENST ID: ENST00000463234
  CDS Start-End: 1-246
aataatgacattttatcttcttgtgagataaaaactggatacaacaaaacagtacagattccaattacttcagaaaacagtactgtgggtttgtctaatacaggctctaaattatcttggtattcagcccacaaaggaacaacaccaagccctgagacagcaagtacaagcagactcaaaagggacagtgtcttttggagattttgtccaggttgccagaaacttgttttgcttgcagttggatgaagtaaatgttggtgcacatgaaatttccaatatattagattcacagcttcttccttgtgattcttcagaagcagatgaaatggaaaggctcaagtgtgaaagagatgatgccttgaaagaagtaaatacacttaaggtaacctctaatttagtttccttatgttttcttcagaaaaa

SEQ ID NO: 188527 - DNA, 3456 bp, Homo sapiens
  Payload ID: 17092
  Gene Symbol: STXBP5
  Gene Name: syntaxin binding protein 5 (tomosyn)
  Uniprot ID: Q5T5C0
  ENST ID: ENST00000321680
  CDS Start-End: 1-3456
atgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaaggtgaagaccaaaagcagaaagttttccaagatggtagccaatgatatagcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctga

SEQ ID NO: 188528 - DNA, 521 bp, Homo sapiens
  Payload ID: 17092
  Gene Symbol: STXBP5
  Gene Name: syntaxin binding protein 5 (tomosyn)
  ENST ID: ENST00000367475
  CDS Start-End: 1-521
gaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctggttcttcatcaccacacaattcagatgatgaacaaaaaatgaataattttatagaaaaggcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtg

SEQ ID NO: 188529 - DNA, 3297 bp, Homo sapiens
  Payload ID: 17092
  Gene Symbol: STXBP5
  Gene Name: syntaxin binding protein 5 (tomosyn)
  Uniprot ID: Q5T5C0
  ENST ID: ENST00000367480
  CDS Start-End: 1-3297
atgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctga

SEQ ID NO: 188530 - DNA, 9177 bp, Homo sapiens
  Payload ID: 17092
  Gene Symbol: STXBP5
  Gene Name: syntaxin binding protein 5 (tomosyn)
  Uniprot ID: Q5T5C0
  ENST ID: ENST00000367481
  CDS Start-End: 109-3456
actcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcaacggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagtaaaatgctcagctcccttttcaaaatgccctttatttgctaactgttccaatacactcaggtgatgagccaattaaatgttagtgcacatgctatcgcatggaaaattacaagcatctgttgtcaataattatataagagtttagtctgatgacctacaaaatattttgtgtagaaatatactataaatctgtacatatcctttcaaggttttaaaaaaccaaaaagaaaggaaaatatgtacactgtgataactaaattatttctgtattggaatataatacaatttgagaccagcaatggacaatgaatgattgtttcatagaatagcattacgggcaggaaagaaaccacctagtagatctagaagtaagcaatctcagaatacagactaatctgagattattattgattgttgttaaagcaacccagcaaaagcaaaatggaagcattaaaattaatgttaatgaaatttaaatattgtcttctataaaaaattcctttaaatgattttgttttttcattaagagataatcagagcacaaattgatagtaaacaggatggttgtttttctattctatatgatcattaaaggaatatgtaggacatcttaactttttcatacagtctgttatgcatattttcctctacttttcattaataaagcttttatgtttacattttataacatgcactactagatgcaaaagtttacatcaaagtttactttaaatatcatttggtagggactaaatgtgtgtgatagagataattgatcaagccaaaagaaatattttttaaataagcccttttcaaaagtttttgaatttatagaaagcaccaatgaataacatatttctgtttcgttaatgtcagctgcctgaacattcagcagtttataaattgcttaatttgtgttatctattatccagtaaacccatagttccatgatatgtcacaggaattgttaggtcctattttaaaggtacagttttgtgaatgtcatcaataaaatcaacagttatggatttgaagaagttgggaaagcattatgtagattaatatactggttggttccctatctatgtggaaggtcatattagctgcaattatttaatttgctgtgttattttgtgttatataacacaaatatatttgtatattaacttcatttttactgtcatttttcctgttgtatacaaaatgaactaatcttgtaattattttcaaatatagaagtatatacattagatggatttccaagattttgtaagaaaatcttaaatcagtgttttgagttatttaatttttaaattaatctacaaattatgcacaacaaactagagactcagttaggattagaaagcttaaagtatgtttgagtgtaggaaataagcttctcagagttatacttgattctgtctgtagataagagacagtctacagtaataactaacccagggaatttactgtaatttgagaggtaacatctctatttttttctttttaaatacagaaagtaatagtcaccagcaagccacgatttcaggaaaactgactaaaaaaaaaagtcaaaatagaaaatatcagaaaaatgaaagatttttgtgtgccctctccatatcctcattgtttttgttgcatttgtccttgactctaaaatcactgaagtattcatgattagtagtttgtaagtaggaagtggtttttctgtatgtaccatatatccagttcatttcagttttcaaactaaaatccatatgtatttgctgagaaagttatttgaaatcttatattctgacaaattctgtacattacatccatttgaagttttgcatcatcttaacacttttgctttgcatttcaattgtacaaagtgtttccaaaaaaatggttatagattcgactgagctattactaacttctccatttgattttttatggatgtgaaaaatgctgctacttgtctatgttattatgtgtaagtatattacaatttaattaagtacaatagtttaaagaacgaagcaatttttttttttttggcttagaacttcttaattgtaggttcctctgaagcgatttcatgtagatatgtgagtgttttaaacaagtctgaaagtgttacatacttttaggttacaggggtgctggggagacagctgaggaaaggaagaatatgtggaagacaccacggagttcaaagttttaccctgagttctatcttccatgtatgttttgcttaaggcatttctcatgtgacattagaaaagctatatccaaaggtaaattttttgtggcaaagatttattttacactttaacttttgggattttatttgtttcagcaaaataaagagcactgaactttaaacttgaattttttctgcacttttttaggtaatgaaaactttttattatcatttaatccacattgctcagtttaaaccaagtgatacatgtgtataaaacataccaaaatcatgaatatgctgctagctgtaccttaaataaactgatcagttttaaaacctttaatagggttttatatagatttaaaaaatagtaaaataatctgctgtatgtttcagtgttcttggtcttaaattattgcaacactttcagatttgttttaagatcatacagtaacatgttatatttatacatactgctagaaaatatacttttagttttaaaatggaatttttataaatgtactttaattttaaaatggtgaacttgttaagtttaagtcaaagtacttaaaaagtatgtatattatccatacaaaaagttatgttttacgcttataataagaaatactggtatctcatatcgagatacaattaattttaaaaaatcatacatcatttaaaaatcttcacacatgaacaggaaagatatcatttctatgctttaaaaaaccctctattgagcattttcaaatattaattttattttgggggaaaatgcccacaacaataattgcaagatctttctcaatagcttcagtttgctgttggatgcctaccttaactattgttttaaaatatagatatatatatatatatttaaaatagttttccaggtattttcttctaccttttttaaaaataaatttccaaaaatgaaaacagagtttatgtatttttgtcaatgaaggtttttattttgtagtttatagaatttgttccttatcagtttgatacttgatcaacattcttagactttttaatctgtatttactttggggggaaaaaagcactcctatatcttaaatgtccttcttttttcttttcccttttagggtatttgttctcttggattgaaatttatgcccacagatttttcttttcatttgaaaatgaatgtgaagatactgtttacagcttttgttaattgcacttttcatcactctgatcaatttcttgtaaagtgctatgggaattatttttcctgtgaatattaatgattttactactgcctccgaagttttaaaaaaggttctgtagacagaaaacagttgttgcaaccaaaaacaaccaaaaaaagaaaaaaagggaaaactggcttacctttctcagatgaattaaatgattttaataacttcccaattaccagggttataacattgctttcttcagttattaatacagtcaaattaattttaacaatataggcacaattcatttacaaattcagtacagtagtccagggctacatgtaagtggtctctttattttattctttacatcagaaaaatcatgaatgtcagttttgccagtattttacaatgaggcttatcgtttaaaattttatagtgtatgacatgtaaataaaccagtatttattgtaggttgtttgattcaggcatttcaaatggatataggttaatggcaatggaatcctatttatttggtagttggttttgtttgtttttgtttatttacttttgctatttgttttgtattgtctaaactttgcttcaactgaagacagtgtaaggagttgaaaatacaatcaacatagcaatggaaagcaatgcaaagagggtaaatcttgttttaatttttttaactttttttttttgtaaataaatagtactgtgatactttaggtgtgacctctattccacatgatagttagaaccagaaaaacacttttgctttctagttatactattggttcattgtaaatgcattaccaaaagacaatatgaaaaagagcaagattaagtttttctaacattgtccacttcaggggcaagcatgcttggtatagagctctagcttgtgtataccttaaactgtaacttgcaggtgtttttcagttgctgcactttttatttaatcttgctcagtcccagtaactatctcaaaggtaattgctggaatatgcattttgaaatacggtttaaaaaaaatctgtgtattgtttcatctaaaaagaaaagcactattggaaacactaaaaacgtgttaaactttgtagttattttgcattcctgtactttacaaactgtcatcacagcaaaaagtttaaaattaggtaatgaaatatttttgtaaataaataccgttaagctggtattttaaaaaatgtattataaattaattaatgtttctggaaaatgttcatatatatgtatatgaatgtctctttatgctgaagggctctgattgggcaaaataaaatactctaatctctcctgaaactaaacaa

SEQ ID NO: 188531 - DNA, 791 bp, Homo sapiens
  Payload ID: 17092
  Gene Symbol: STXBP5
  Gene Name: syntaxin binding protein 5 (tomosyn)
  ENST ID: ENST00000392291
  CDS Start-End: 1-791
attgaattatatggctctaatgatccttatcggagagaaccccgatctcctcgtaaatctcgacagccttcaggaggtgtgctgattgtgacttcttgcatgtgcggcctttctagcttatattctgaatctatgaaaaaactacgttcttcttttttaaccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctatgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattac

SEQ ID NO: 188532 - DNA, 2160 bp, Homo sapiens
  Payload ID: 17092
  Gene Symbol: STXBP5
  Gene Name: syntaxin binding protein 5 (tomosyn)
  ENST ID: ENST00000546097
  CDS Start-End: 109-1035
actcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggtttgttgagatccaacagatatattccaacaatagctatattccaacaatagattaaatgaactctaagaggtgtatcatctgtttgactcttgcatccttcattgtgtgacctgtagcatagttatctgacttctttgtggttcattttcctcacttatgacatagatggataaaatgtcagacattagttgtttaattgagatgataatgtatgtaaaacatttcaagcagtttctggtatataataaactctataaatgattgagaagccatttttttaaggaaatcccctgccaccaattgatttttatttgttacatttgtcctatggcaaaggaattaaaataggaaaagcatggtagcaaagaaagaaaaacaggaagaaaatctgaaaaaaaaaatctatgattataatacaaaatgaattggctaaatatttaaattaatagtgactaattaggttctattcttatctagttattttaacaaatattgactggcaacaaaggcagcagttcagggaagattttttcctctgtgcttcacctgttccagtttttactcctaaataatgttaatatttatgagttcaggtttcttcaagatggcagtaatacttttcctttcatagaattagaaatgaaaatttaaaatgttgctcttttgtaggcatttgtaaatacagtcatccactacctaatagcatcatgatcagtggtggactgtatatacaatgacggtcccaataaattataatattgtactttactgtaccttttctatgtttatatacacaaatacttaccattgtgttacagttgcctacaatacttagtacagtaatatgctatataggtttgtaacctaggagtaataggctatacaatatagcctagatatgtagtatatcatcgagatttgtgtaagttacactctatgatgttcatacaatgacaaaattgtccaatgatgcattcctcagaaggtatcctttgttgttaaatgacgtagttatactgttaactggatcagtaagatcaccattttgtaacagtgttctctactttctcaatttcttttgtcacctaagatgggaaattcagtaaattcaacatattcttcttttctctc

SEQ ID NO: 188533 - DNA, 9496 bp, Homo sapiens
  Payload ID: 17093
  Gene Symbol: STXBP5L
  Gene Name: syntaxin binding protein 5-like
  Uniprot ID: Q9Y2K9
  ENST ID: ENST00000273666
  CDS Start-End: 272-3832
gacgtccccgggcaccccgcccccttcacctcccagctttgccggggaagaagcagggcggggcaagctaggggccggcccgggggcggggcctgcctcccacggcgggagggcggagcctgctctggagcctgactgctcggttaggacctcggagagcgccaggcgccgcgaccagagggcccagagaagcggccggagcccgcctacctcggccccctcagcttcccgggctggcaggcggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcagacaacttttgcatgcgtggcctgtctaacttttatcctgatttaacgaaacggatccgtacttcctatcagagtttaactgaactgaatgacagtccagttcccctagaacttgagcgctgcaagtctcctacctcagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggacatgctaggagatttgtttactcccatagagacaccagaagctcaaaacagaggctttctcaagggactgtttggtggaagcggacaaacatttgacagagaagagctctttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgagttaatgctgaaatacaaggataagaaatggtaccaattctgacttctaaagaagctgtgactgctttgagaaaccatattcagggaaaccaaatttattcccagcatcactactcaactgctagaagccagtttcttctacaaaatgttccatttacagtcaatctgaaattttcataaaagagatgtatcagagacactgtgcaacccaaaggctggagccctggttaaaatcccaaaatacggctgaatttgccttttcccatgtggaatggagctatcatcttggcatgtcattcgataaggatttatatttagtaactacggggagtcctcttgatttgaaaattcctgtacaaacaaaagcattaatgcacttaatgaaaaaaaatctttgcatgataaattaacatcttaaggggaaaagaaaaaaaagcatgttgtgatagaagaaaaaaagattcatggtaaactatttctatcaattgggccacactcaacaatttaaaaaatctgcatttgaagatgtcagtgcatttcaaatatatttgccatacccaactgaaacggaaaacaaaacaaaacaagaacccagagttttctcctcatctgtaactttcattgtactagaaccttattgaattcttatggcaagagtctgattaatgttctctctccatgttttacatcattcacagttgtgtcaaaatcaaatattgccagtatagtaaattattcccaacacaatcagtttcatttctatcaccttcagaatgggttgctgtttttagcacaaaccatgcagggttgggtcacctcaaagcattttcttcagcctggcttgtactctataggggagttggtagtaggtgtggggaatctataggaacaatagagttagctatgagaactgacttcacaaaaagggaaatttcacacaccccaatttcagcttctaaagtgatatattttaaaagcttcatttgtatccttgtctgccagttacacagtatattactgttcaaacccagtagggtctgcaatcgaaaggtgctcttgcagcctgacattcacaaaccaaactggtcattctctttagtgtgattcagtaaaatctcagttaatgttttgggaaagggattctgatttatgacatttctgatttacaagggctttccttagaaaatacctttcggtttgatacttaccactggaaattggttcgatacttaccactggaaatctttataaaatatagtgatctgtttgctatcttggtctcagtcatcattatagacaatagaaatacataaagagtttaatgatacaaaatcaatgcttttgtccctaggtcaaataatataagccactagattatgtcaatagatgccaaacacttgtcccttattaaagactcttttaaagctggaataaagaatatccttaacatgatacaaggtatctataactcaccagaaaagcaccagagtcaaaaccaaatagagacacctactaccatttaacatgattctggaagtcaaaagttataggaatgtatatatacacattccaggacccatcctgtaatatgttgtttcgtcaagaaaagttttaattatggttttggcttattgaatttttgtttatcaaggtctcattggatttacatttgtgtttcttaagacttcacaattttcctggatttcaggttattttattagccaaaaaatcgtatttttatttcctttttagtctaattttttgctagaagttgtactttctagcaaatgtttctagtggtacaatgttctcagtaattttgaggagaacaaagatgagtgaaagagttagataatgtacactaggatagcatttctcagagtccttgaatcctcttgttaagaaagcctctctgaatctcccagactcctgtgaacagccttacggtaacagaatctggcttggaaacacagacattacatgactgtataatttatagaattataaaattatatggtaaaaatattaaagaaacttaagagtaggatctagaaaatactagtggccaaattgcaatgtattctttgtaccatctgtttcaaagacttagttttctgattttcagaacaaatactttatcgtttctgtattttaaaaaaaactaaaagagtaaaatattagtttattttagaaataatgaaattcagtccaaagtagcagtacatttgatgagtatttctgaagccttcaataagatttaacttgttttaacttgatctacatcgagatttctcaaaagcagcactattagctgaaagtctttgttgtggggaactgtcctgtgtattgtaggatgttagcaacatccctggcctctgtctactagatgccagtaagaacctcctagtaatgacaatcaaaatgtctccagtcattgccaaaatttctcccagttcacagccactattctacatcatacaaagaggtagattgtgtgaatatgtaatatatgttgttgtataaaactgtacaataagtatacaatgtcttagcaagataaattattatacccaaaattacatgtgtggttcatatgcaataagatacaattttgaagaaagcttataggaatcagtgaaaaataacaactacagaatattttaaggcacacagagaaaatatcaaaaaggacattatagcatttcactgtagaagtgcttaaaaccttggcctcagtgaatagatcaaaagtttataattagcacaccaattggaagtaaacaggtgcttctcaaatgcttgaaaagaaaaggctctttgaagtagttaaaacgtgtctttcaaaattgcttttataagcccttccttaacgtaagggtaacttcatctcacaaactcctggttagtggaatccaaattaatgaggttttactgtatcaaaattatttttataattcaaagagatgatagcaataagaagaatctaatgtggatgtgatttttctctttgaacaattctgttctgttgcactgaccttagcacgcacgcacacacacacacaccatcgccaccactaccatcatcatcttatcctcatctttggaaaataagtactgttgatccatgtaatcctttgcatagtctcatctttactatctttcttctatttcggaacataagaaaaatactcctaataacttggacaatgatacagaaagtgactctgagccttagttaccatcaaaattacattctatctgctaaagcgacatcagaagataaggcttgcaaaccacagtcccaacaagttgaccttgtctccctatgatttccttggaagataaggcctttttagtgttacagtagaaaatgggccttttcatttattcatctgtgagaagctagaggtatttgtttccctgataataacgtgagcaatagtccctaccttgaaatcatccattagtcttggagtttggagggaggaatgattgattcctcatttgttttaatcacctacaaaagcagtactactgactttgcttcttacacttcactgagccccagactttagggccccaatcattgtcaagatcattgtctaactggaactctgaaaggacagtgacagaactgaatgagatgttttccagtgattcagtcacaaagacaattttctcagatcttttgaaagtgattctcaaataaataaatcaaaatccaactcctttccctcaaagtttctagggatctgaaggaaaaggtttactgttggagtccctttttatgtgacccatgtaccagttttaaaggcatcatctatactttatctacatgaagggatcaccatgactttgagagaaaaaagaatcagattaggcctaacattggttgaagaagattaaaatagattcttatattcaagcagaagggaaaaatgaagccaatctagaaaagtaagctaaaaatcctctccttggcttaggatcattgggtcaaactgggagtatatctgtgtgattacaacctgctgctatgagaaaaaagaattgtaacttgaccatgttggctcacacagggcaatgcaaaagaagtcaaaacattcatatcaggtcttggtatctgtgtcaggagaaacgtggtggctttcacagcttcttcacctctgtcctctgtcatgcaactccatttttggctaggtactatttcacatgcacactgtcctgggtgccagaaatacttgtggtgtacttggtttgagcagtacctctagtatgcaccattccagggaacatggttgtcaacataacaagtttagtgtgtgtatttgcagacaacatagccctgaaagcatgaaatgtagaataggtaaggtctgtcttagaaaaggaggaggaagtaccaatttggtgcaagaagatcgtggtgaggaaggacatgggagccacagtgaagtgaaagaggctttaaggaatcagatgcacagatggatgctttgatttacacatttatctagaggagtgattctcaaccttgactgtacataagaatcacctcaggaaatttttaaattcccaattatattaaaatcatttggagtgggaaccagacaccaatatttgcgaaagcctccaaggcggttctaatgtccagccaaagttgattatcactgctttatggccaactaaggaaaccttgtttgtctgccttggctggtgctccagccccagttctgagtggtcagggaaggcaagatgtaagatatagtaatggtatttattctgtatgtctcacagaacaaaagcatttgagaatttctgaccaggcagtgctccatcaactcttaataatcatctttgtgatattctcctatgtgacttgtccatcaattattccaattcaaaggtctaggttttttttcaattgtcttacacatgtgacatcacaagataccagaagtagcacagtaaattcaagagcatataaagctaagtggaaaactaattcttcatatttagacagtggaaattctcaaaacaatcatttgctaaattaggtccaaatttattattcattcttcttctggaggagacatgggtaccaggtacctgttctgctgtaggtatatttcactggacttggtcttagcaaaaaggaagaacaaatcttcctttttgattgttatctcaatcaaaagctcccagggccacttggatttattttcttagtctttggacatgtgtttaaaggaaaagaatacctgtaacttcctatatgacatccagtgccctgaaagggtgcttacaccttcaaaaaaggagagtccagcctatcaaaggcagtaacacataatgagaagaaactcagagttattgcctttcatactgctttccctctgctgttggcccacccttcttgactgcaaagccagaaaataaactagatggtggttttggacaattgtacacaggaacagaatctctaataacctataatttttagtacttaattatgtgatgttttattctaggaaataagaaacagatgacatcattgatgtatctttctttcatcttcagaatttttgcatcttttcagaaaatgacaaattactatttttctgttgcactcagcaattgtgactatacttaacaaaattcttgtagtctgtagagatatcaataaaattgtatatgtttgtacata

SEQ ID NO: 188534 - DNA, 479 bp, Homo sapiens
  Payload ID: 17093
  Gene Symbol: STXBP5L
  Gene Name: syntaxin binding protein 5-like
  ENST ID: ENST00000495504
  CDS Start-End: 99-479
cccccaacgtcgtttttctgaaaataaaatactctgagccgaacgtttcgaagaaggaaagtccgcccttaagagagagacagagtcttgtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtc

SEQ ID NO: 188535 - DNA, 3067 bp, Homo sapiens
  Payload ID: 17093
  Gene Symbol: STXBP5L
  Gene Name: syntaxin binding protein 5-like
  ENST ID: ENST00000472879
  CDS Start-End: 55-3063
ccctcagcttcccgggctggcaggcggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcaggtttaactgaactgaatgacagtccagttcccctagaacttgagcgctgcaagtctcctacctcagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgaggtacttgccttcttataaattatctggtaatcacaacaataccagcaaggtacaatcctaaaaaa

SEQ ID NO: 188536 - DNA, 3813 bp, Homo sapiens
  Payload ID: 17093
  Gene Symbol: STXBP5L
  Gene Name: syntaxin binding protein 5-like
  ENST ID: ENST00000471454
  CDS Start-End: 139-3627
gactgctcggttaggacctcggagagcgccaggcgccgcgaccagagggcccagagaagcggccggagcccgcctacctcggccccctcagcttcccgggctggcaggcggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcaggtttaactgaactgaatgacagtccagttcccctagaacttgagcgctgcaagtctcctacctcagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggacatgctaggagatttgtttactcccatagagacaccagaagctcaaaacagaggctttctcaagggactgtttggtggaagcggacaaacatttgacagagaagagctctttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgagttaatgctgaaatacaaggataagaaatggtaccaattctgacttctaaagaagctgtgactgctttgagaaaccatattcagggaaaccaaatttattcccagcatcactactcaactgctagaagccagtttcttctacaaaatgttccatttacagtcaatctgaaattttcataaaagagatgtatcagagacactgtgcaacccaaaggctggagccctggtt

SEQ ID NO: 188537 - DNA, 3396 bp, Homo sapiens
  Payload ID: 17093
  Gene Symbol: STXBP5L
  Gene Name: syntaxin binding protein 5-like
  ENST ID: ENST00000471262
  CDS Start-End: 9-3396
tgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcagacaacttttgcatgcgtggcctgtctaacttttatcctgatttaacgaaacggatccgtacttcctatcagagtttaactgaactgaatgacagtccagttcccctagaacttgagcgctgcaagtctcctacctcagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggacatgctaggagatttgtttactcccatagagacaccagaagctcaaaacagaggctttctcaagggactgtttggtggaagcggacaaacatttgacagagaagagctctttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgagttaatgctgaaatacaaggataagaaatggtaccaattct

SEQ ID NO: 188538 - DNA, 3036 bp, Homo sapiens
  Payload ID: 17093
  Gene Symbol: STXBP5L
  Gene Name: syntaxin binding protein 5-like
  ENST ID: ENST00000497029
  CDS Start-End: 30-3032
ggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcagacaacttttgcatgcgtggcctgtctaacttttatcctgatttaacgaaacggatccgtacttcctatcagagtttaactgaactgaatgacagtccagttcccctagaacttgagcgctgcaagtctcctacctcaggacttgctaccagaacccctgagtcagcactaggcttttataggaatgaaatatcagctatgagacagaggaatcaagtatatcacttgccagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgaggtacttgccttcttataaattatctggtaatcacaacaataccagcaaggtacaatcctaaaaaa

SEQ ID NO: 188539 - DNA, 2321 bp, Homo sapiens
  Payload ID: 17093
  Gene Symbol: STXBP5L
  Gene Name: syntaxin binding protein 5-like
  Uniprot ID: Q9Y2K9
  ENST ID: ENST00000461772
  CDS Start-End: 108-332
ggcgccgcgaccagagggcccagagaagcggccggagcccgcctacctcggccccctcagcttcccgggctggcaggcggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggtaagatgtatgctttcaaaaggaataaacactggcaattcagtgccttgacttgaagtaagagagatggtattaatgcgtttggtagaaaaaagtaataggacatagcttctggttctaaacatcccttttataccacctacagatcccaacattgtaccccaaactttccatacttcccttcttcctaccaacccacatccctgttttgtaagctgtagttatgtactgtcccaaccaaaaattggataatggatggttgatatatctggggcagaggagataatataggaaattttgtcacttttaagggctgaggagccagtgagagaatggcactatttagatgtgactttcagagttaattcctatactactttatagtctgttgttttctagattctcccacttgtttccatttctgccatttgattccagtaagttatgaagactgtggttttaattttaggttttacttttcttattgccttccacattgagaagagcattttaatcctaaatgaggattttaatcttaattgaggatttatattggatctgtatacctaatggggaagaataagcaattcaaatgtataaatatatataattcagatgactaaattatttgataatattggtgatgatctgagttctatgtttacctcatatcattgattatttgtaataatagatatgtcagaaactaacagttgatcaaacatattctatgttacagtttctgagcgttcgttatcatgtcacatttggaaagtagtggtatgttttctgtaatgggtgacccatagatcacaagcattcttagaattatttcatgctgtttgtctgccatttttttgtaccatagttacatgctccatcagtaaatgatcaaattattgcaacattcttccaggatgtaaatgttttagtctttagctggtttacttagagattactttacatttagatgcttacttagagatgctttatttagagattgccattacagaaaccttgggtagatattagctatacataccactcaggattaactatttatttctacgataggggataagttctgtccacacacccccagctaacccccaatactcatgccttttatatgtaaaagtataatatgagctagtcataaattttctacttacttccttatgttcttctcaaatatcagtttctattagttcttttggctagactggacatttgatacttttattttttttaccatatccatatttatttcatcagtttggattgttttctattattctgcttttctgttgaaataaagttctgtttacaggttgttcaaca

SEQ ID NO: 188540 - DNA, 3114 bp, Homo sapiens
  Payload ID: 17093
  Gene Symbol: STXBP5L
  Gene Name: syntaxin binding protein 5-like
  ENST ID: ENST00000492541
  CDS Start-End: 30-3110
ggctagaggcgtctgaggaagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaagacagttcggcatggttttcctcatcagcccacagcattagcctttgatccagttcagaaaatcttggctattgggacgagaacaggtgctatacgaatactcgggagacctggtgttgattgctattgccaacatgaaagtggtgcagctgtcctacagctccaatttttgatcaatgagggtgccttggtcagtgcaagttcagatgatacacttcatttgtggaaccttagacaaaaaaggccagccatactccattctcttaaatttaaccgggaacgaattacttactgtcatctacctttccagagtaaatggctttatgttggaacagaaagaggaaatacacatattgtaaatattgaatctttcattctttctggatatgttatcatgtggaacaaggcaattgaactatccactaagactcatccaggtccagttgtacatttaagcgatagcccaagagatgaaggcaaactgctaataggttatgaaaatggtactgtagtattctgggacttgaaatctaaaagagcagaactgagagtttattatgatgaggctattcattcaattgattggcatcatgagggcaaacagttcatgtgcagccattcagatggtagtttgactttatggaacctgaaaagcccaagtcgccctttccagaccacaattccacatggaaaaagtcaaagagaaggaagaaaatctgaatcttgtaaaccaattcttaaagtagaatacaagacctgcaaaaacagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatgaatttcaagaaccctatgctgtcgtggtacttctggagaaagatctcattgtagttgatctgacacaaagcaattttccaatctttgaaaatccatatcccatggacattcatgaatcaccagttacatgcacagcatactttgcagattgtcctccggatttgattctagtactgtattctataggagtcaagcataaaaaacaaggatacagtaataaggagtggccaatcagtggaggagcttggaaccttggagcacaaacatatccagaaattattattactggtcatgcagatggatcaataaaattttgggatgcttctgcaataactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtgtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaatgtgaagacacggccagtgcgaatgcctccaggatatcaagcagaacttgttattcaattggtgtgggtagatggtgaacctccacaacagattactagtcttgctgtaagctcagcatatggaatagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcagacaacttttgcatgcgtggcctgtctaacttttatcctgatttaacgaaacggatccgtacttcctatcagagtttaactgaactgaatgacagtccagttcccctagaacttgagcgctgcaagtctcctacctcagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgaggtacttgccttcttataaattatctggtaatcacaacaataccagcaaggtacaatcctaaaaaa

SEQ ID NO: 188541 - DNA, 4132 bp, Homo sapiens
  Payload ID: 17094
  Gene Symbol: STXBP6
  Gene Name: syntaxin binding protein 6 (amisyn)
  Uniprot ID: Q8NFX7
  ENST ID: ENST00000323944
  CDS Start-End: 453-1085
gaggcctggggcgggtcgcgggtcccggcccccagcccccagcccctagccgctgctctttgccccgggccagggcgctcgggctcgcccacggcggcactgagcatgctcagaggcggccgcgcgggcaggtttgcttcgcaggcgctcgcactcggcggcgggcgggcgcgcggctgcagctggagctccagcgcccggagttggagttgccgggagtttccccccaacccctcccttttcgcgcgcggcagcaggagccggcgcgggagccgcgagcggcggcgagccagcacccgggccggctaagccttgtccggagcccggagccccgcgcggggcagccccccggggaggagcctcgtgctctgggacgcgtgccgcgcactggcacggcaggggcgcgagccaggctgcacgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcaatacagttggtcacacacctcgtgattttctattactcaagataataaggggcttagggtctagaagttctgtttcctagagggttaaaatgctaaacataaaaaaagctgtgctttttttgtgaaactaggagacaagctgcacatctcagacacattgtaagcctaccactgcagcgcattgatttttaagctgcctgaatcttcaggacccctatctattccatcctatccattttgctgattgagtcgatatgtattgcagcctcttacataggagcataagatgacttttggattgttaatactgatttaaatagctgaagttctcctaataaagcattcccaaggagagagaaagtttgtctactgggggtaaaaatatcagatggtgcacattaaaagggagatgagatttgtcggagacagatttcagaatccttttagatgatccaattcaagaaaaccctctataaaatttaataaactgtataagttaactataatattttatactttctttttggtgtcttaaaaatttaaagaagcgaggaacatgccatttggtgagtaccgttggaagctattttaatttctaggaaaagccccaaatatcactccaaatagattttgtttgcagatctcagttcagaatgcacacacacacacacacacacacacacacacacacagagatgtatttatctttccaaattggattctggtttcagagatagagagttggtataaataattgaaaggataaatctaaaaccccctgacagtccgccaaattcaagaacagaagtggttgccaactctctaacaacaatgtttgggaagctgattccaaagtagctgaggatgaggtcataagcatactgtgaaacccaagattcttcttccctggtagaattacaatagttactcttgataaatataagtattccatgtcttgccctctttcctcactctctgcttatccttttagacctaagtttcattggaaatagcctgaattagaagaaagcccatccgaatctttattagccccctctaatgattagtttccaggctgcgttcatacctttgacctctcagtgtcaaagtcctacctaggcctccccacaacagagagggccgtaacagcaatccctgcccctcctttacctcccagcctcttgcagaggagcccagtgataacacatgtgaagttctttgctgtcctcttgtagaaggtgctgcagtgcaaagtattaatacggtcttagacaaaataactgtcatgatttgggaccagtttggttgagcttgtcagaagacatttcatttgtttcatttctgcacttctctatgaattttgggatactatatttctgtgaaggacttattgtatagacaactcaaaaaggaaagaaactttccagtattaccacttcttcctggaatatagctgtagtatttctcactagtattattagatacctgtgtacagaaagtatgcagttattcaggttaatgtttcatattaaagaatgtatttgtaaaatgtaacatgatcagtagttaccttttttcaagctctgaagaagttcagattacgtgttagacttaagttacagtgaaaactgttttaatactacttttgtggctagcaaaggttgtgcatctatttaaaattatttacaggatgctctaaataaggggcattaaagataggtttagctcttaattttagaaattgtgacactactgatgtctgtcatacagttattcttcagaagttctctgagatgtcaaatataatttttgtttaattcagagataagtaacacctgctctattgattcactattacaacaaaccctaattttgtcattaaatattttaactctg

SEQ ID NO: 188542 - DNA, 4021 bp, Homo sapiens
  Payload ID: 17094
  Gene Symbol: STXBP6
  Gene Name: syntaxin binding protein 6 (amisyn)
  Uniprot ID: Q8NFX7
  ENST ID: ENST00000396700
  CDS Start-End: 336-968
ctcccttttcgcgcgcggcagcaggagccggcgcgggagccgcgagcggcggcgagccagcacccgggccggctaagccttgtccggagcccggagccccgcgcggggcagccccccggggaggagcctcgtgctctgggacgcgtgccgcgcactggcacggcaggggcgcgagccaggctgcacgtttcctgtttagaaagttctgctccttcataaggaccttgaagtactaggaggaaaggtgctttgtgtgtggagttttccatgaagtgcagtcccaactaaaaggctgcgttaaagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaatcagaatcgcagatagaaatctctttcctgagttacagtttaaatactcttgctacttgtatccagggtgtttacttggaattatcatatgaagggtaaaaatttgagagtaaagccctaaagaaaagcctacctaaaaccctctgtgtactcacagatgtttctcttgtcactgtcatagtgatggtcgctggtatggaaaagtgcttatatttttatcaaaaaattgatttgtccaggtaaaggtctgtgtcaatgataatgtgaacaagtagtacatttaaaatgtttgtcttgtctttttacagtcatgcctattttagagacaccttcataatgtccttgggagagggcctttagtttcttggtatctggattttggaggttttgatgttgtttttgctatctatttatttaatgtaatttaatatgtgagtttcttgacaaattgcatttcatggcaattgcaccttgcctggtctgatataaaacaccacaatcacaaacctttacattgcagtcagtttcaatacagttggtcacacacctcgtgattttctattactcaagataataaggggcttagggtctagaagttctgtttcctagagggttaaaatgctaaacataaaaaaagctgtgctttttttgtgaaactaggagacaagctgcacatctcagacacattgtaagcctaccactgcagcgcattgatttttaagctgcctgaatcttcaggacccctatctattccatcctatccattttgctgattgagtcgatatgtattgcagcctcttacataggagcataagatgacttttggattgttaatactgatttaaatagctgaagttctcctaataaagcattcccaaggagagagaaagtttgtctactgggggtaaaaatatcagatggtgcacattaaaagggagatgagatttgtcggagacagatttcagaatccttttagatgatccaattcaagaaaaccctctataaaatttaataaactgtataagttaactataatattttatactttctttttggtgtcttaaaaatttaaagaagcgaggaacatgccatttggtgagtaccgttggaagctattttaatttctaggaaaagccccaaatatcactccaaatagattttgtttgcagatctcagttcagaatgcacacacacacacacacacacacacacacacacacagagatgtatttatctttccaaattggattctggtttcagagatagagagttggtataaataattgaaaggataaatctaaaaccccctgacagtccgccaaattcaagaacagaagtggttgccaactctctaacaacaatgtttgggaagctgattccaaagtagctgaggatgaggtcataagcatactgtgaaacccaagattcttcttccctggtagaattacaatagttactcttgataaatataagtattccatgtcttgccctctttcctcactctctgcttatccttttagacctaagtttcattggaaatagcctgaattagaagaaagcccatccgaatctttattagccccctctaatgattagtttccaggctgcgttcatacctttgacctctcagtgtcaaagtcctacctaggcctccccacaacagagagggccgtaacagcaatccctgcccctcctttacctcccagcctcttgcagaggagcccagtgataacacatgtgaagttctttgctgtcctcttgtagaaggtgctgcagtgcaaagtattaatacggtcttagacaaaataactgtcatgatttgggaccagtttggttgagcttgtcagaagacatttcatttgtttcatttctgcacttctctatgaattttgggatactatatttctgtgaaggacttattgtatagacaactcaaaaaggaaagaaactttccagtattaccacttcttcctggaatatagctgtagtatttctcactagtattattagatacctgtgtacagaaagtatgcagttattcaggttaatgtttcatattaaagaatgtatttgtaaaatgtaacatgatcagtagttaccttttttcaagctctgaagaagttcagattacgtgttagacttaagttacagtgaaaactgttttaatactacttttgtggctagcaaaggttgtgcatctatttaaaattatttacaggatgctctaaataaggggcattaaagataggtttagctcttaattttagaaattgtgacactactgatgtctgtcatacagttattcttcagaagttctctgagatgtcaaatataatttttgtttaattcagagataagtaacacctgctctattgattcactattacaacaaaccctaattttgtcattaaatattttaactctgtgatga

SEQ ID NO: 188543 - DNA, 1970 bp, Homo sapiens
  Payload ID: 17094
  Gene Symbol: STXBP6
  Gene Name: syntaxin binding protein 6 (amisyn)
  Uniprot ID: Q8NFX7
  ENST ID: ENST00000419632
  CDS Start-End: 716-1348
ccaggctgcacggtaggaccggggcgaggggagccaggcggtcagggcggaggccaagcccgggagatgcggttgcagccgccacggctgttggggcgcctggcgctccgtccgaggcgggtggctgtgaggccaggggagtaggcaggctcccagagagattcttccaagttggcgggtggcgggagagggggccgcgcgccccggcgcagctgctttgtgcgcgcagagagggactcgtgtccctggttctctccaaccctgggacccgttgtgcgggcagtattgggcaagccgcagaacggagcgatttcctccgagaaagttgaggatggagcctttttttccgcaccgtccccgcgatggcatgggccccgagaatgctgccccgaggctcccagtgtgggggagctcggggtcgctgcgcctctagcttgagcgcagaaatccgcgaatcactccgatcttcgcgaactctggcatcttctaggaaaatcattactgccaaaactgaggcgagcttttctggcgggcacggcaccctgcccccagggcgctggccctgggcgatgccccctttccgatctcaggcttggtcaagggcgccaggttccgaattcgcgcttgccgtgcacgccggcatcgagcctcaccaacaccgccgggcaacgtggctggagtagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaaaaaaaaaaaa

SEQ ID NO: 188544 - DNA, 3355 bp, Homo sapiens
  Payload ID: 17094
  Gene Symbol: STXBP6
  Gene Name: syntaxin binding protein 6 (amisyn)
  ENST ID: ENST00000548182
  CDS Start-End: 137-334
gcgagccaggctgcacgaatgtaagctccatgagggaaagtactttgttgctcttcttctcctcagtatcctcagcgttaggacaatgcagtgatattgaatgaattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagatatcaagtcagcttcaaaggagaaaacatttagtgaattttagagagaagaccagctaatgaggatgaaacgtgtgttatggttgaacatcccagcgtgtctgctaagaaattcagtttaagaaaaggccattatcacattgtagtggtggactgaaaaagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaaggtgacctttcggggaagaaaataactggctttaacagaaacaccacttctgctgaggaaacaaggatggataacctaaaaagcaatgagaagaatattcccagctgagttgcggtgacctcttctggaggctcacgctcaggtccagctggggatccagctctaagtggatgactcctgccttctcttcctgcatcccctttgcacagcgctgtcttgtcatctcattcattctctgtcgtgacagggtcttactgcactgttgcccgtggggcccatttcgagttccttcaaggagaattggctagatctatctgaaaatgcagacagccctgctggaggccagagcctcagattgctgctgttggtgcagaggcagagagtgaacttggattgaaggtctccctagttccttcctcctttctccagcctctgtgacacagagataatgatgacatggaaatgctggcattacagcctcagcttctttaacaacaacagcagcttccgtgatttcagtgggagacggatagtggaaatctggggaaacatttaagttgttgagttgggtagaggaggctaaagggaataactttataacagtcttcagttctgggaagggtgatggtacaggcatttttctttcatgtcttcccacacagaatagagcaatcaatagtgcactgataaaattctgctaaaacaagagtttaggttaatgattaaaccatgaaccaggttaccaaggaagattgtaaaattgctcttcctaaggtggcatagacaatacctggatgtcgtccacgtaggcgtccctcccagagggggctgtacaaacactggattggataacctaaccagatggcctgaattcttggccctggtagccctgtttccctgatactgtggccaagtttgcgaggcaattgggaaagcaatatggaatagtagttaacatcttgtgtttgaatatagcgctgtcatttaccatcttggtgaccttgggcaaatgcttaatttctctaagcctcagttttctcatcagtagaatagagcactattctttatgagaatagtacctacgtactagagtgttcagagaattgaatgagttcaaagctattagcacagtatgtagcacatataaatctaaattactattatttgtaatcattttcataaattttttttctactgaccctgccctattcagtcacataatgagcactgtagagggattggagaattgatactggtgattgaggatcctcaacacagggacagggaaggaatggaggagaagattttgtgcctcccaaacccaaagggaaaggggtgtgggagggccctcatgctaaatgttgatactatctaaacacagatcagcccttgaaacaggacccatcaggatagaaactaatgcggccaccaaaggcaaaggggtctctggcttgaccagtgggaaaatttatgcctagcagttacctgctttcactcgggaggggtgaggcgtggacagcttgtgtttattttggtttcccctccctcaggtcatctcggggggaagaggaggggttactagtgtctgttaatgtgtatgagagtgagagagtgtcatggccagacttgcagttgtgtgaaactgggatgtgtgcctatgaatcactggcactggcagtattcctaacaagcagattgacctctttagataaggtgtggctattttcccagggaccaggactcttgatttggacctgctagcataggctgaccatgaagctgtcattttactggacaagccacagccaggcctgctggtgaggggagagttcagagatggaacccaagcattctaccccctagacaagcatggctctgttgactcagaaggagtaagctgtgcttacaagtgggggccagaacacatggcagagtcctgagctgaaaatggcaatgccaggtggcagctcctagagctcccagttgaataagggtgccgaaccccagctggagagtttggcacacctttgtagagtccagtagaaaataacttggccttctaacttgttccaggactcctgcagtgacccaggtgcaagagtcaatggatcacttttgcacaaccctgacttcaaaatacgcaggtgcttgttgtctacagtgcagatagaaaatgatccttccgccctgccttcctagactgactcccccacctccactctggtgagcctggtttgaggaaatgtggtcctttcttgagctccgggcttcatgcaaagttaacctcaggaaagtgcaccacaatcgcagaaacagatctgctcactttcccttgccaaaaagcacaatgttgcagcagacgcaatgctttgacggccccgccatagtcagtgagtcagtagacaagagcattacccacactcagacatcctcagatgacatttcttgc

SEQ ID NO: 188545 - DNA, 682 bp, Homo sapiens
  Payload ID: 17094
  Gene Symbol: STXBP6
  Gene Name: syntaxin binding protein 6 (amisyn)
  Uniprot ID: Q8NFX7
  ENST ID: ENST00000548369
  CDS Start-End: 139-465
acagatagaatactggcagaatggaaatgactggcatgtcagtgatgagtttatagagaagcatttaggattttcctaggtcctgcagtcagtgggtgttcttgctgcaagtgcgtcagtcaaacccaatcaaaagaaatgtcggcttgtttcctagacactagacgagcggcctttctgcagtgtgacctgccttcctcttacaggatactcaccctgccggagtctggtcactgtgggtcagctgagccagtttctgatgctcctgctctcctcctttcaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatca

SEQ ID NO: 188546 - DNA, 1311 bp, Homo sapiens
  Payload ID: 17094
  Gene Symbol: STXBP6
  Gene Name: syntaxin binding protein 6 (amisyn)
  Uniprot ID: Q8NFX7
  ENST ID: ENST00000550887
  CDS Start-End: 270-902
tttcctgtttagaaagttctgctccttcataaggaccttgaagtactaggaggaaaggtgctttgtgtgtggagttttccatgaagtgcagtcccaactaaaaggctgcgttaaaggctagagtagtgcagtggcgtgatctcagctcactccagcctctgcctcccgggctcaagtgacccacctgcctcagcctcccaagtagctgggacaacagatgtgagccaccacacccagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatg

SEQ ID NO: 188547 - DNA, 1223 bp, Homo sapiens
  Payload ID: 17094
  Gene Symbol: STXBP6
  Gene Name: syntaxin binding protein 6 (amisyn)
  Uniprot ID: Q8NFX7
  ENST ID: ENST00000546511
  CDS Start-End: 74-706
attacgcttccctagggactgggtgggagagaataggatcgattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcagcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattg

SEQ ID NO: 188548 - DNA, 2342 bp, Homo sapiens
  Payload ID: 17095
  Gene Symbol: SNTA1
  Gene Name: syntrophin, alpha 1
  Uniprot ID: Q13424
  ENST ID: ENST00000217381
  CDS Start-End: 273-1790
cccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggcccagtgta

SEQ ID NO: 188549 - DNA, 5164 bp, Homo sapiens
  Payload ID: 17096
  Gene Symbol: SNTB1
  Gene Name: syntrophin, beta 1 (dystrophin-associated protein A1, 59kDa, basic component 1)
  Uniprot ID: Q13884
  ENST ID: ENST00000395601
  CDS Start-End: 416-2032
gtgttgtgtttggagagagggtagacagcagtgggaaggggacgtaactgagaagcatgaaacaccttgagtggaccatgagacctgcttagagttaggggaaagcttgagaggttcaaggatagaagaactcagggtggttcaggtgtgacatgggttatgtgggcatttctggattgctctgggaaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctattgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaatatgatttctttatcacttaagctttgggctgattaatatctgtgtgggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgca

SEQ ID NO: 188550 - DNA, 559 bp, Homo sapiens
  Payload ID: 17096
  Gene Symbol: SNTB1
  Gene Name: syntrophin, beta 1 (dystrophin-associated protein A1, 59kDa, basic component 1)
  ENST ID: ENST00000520717
  CDS Start-End: 475-559
aacatttgtccctggggtctgaggcaggcatgacctgttgaaaaccccaggccagcagagacacctgtccagggctcgatagaaaacatttcttgcatttaaggacaggaggtttaagccactcgggctacgttgactcttcattctagaatcttgggacagcgtattcccttttaactcctggggagcccagggccttggtctgagtttagcttcctccagggaacccgggtggaaaggagagacaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttt

SEQ ID NO: 188551 - DNA, 2273 bp, Homo sapiens
  Payload ID: 17096
  Gene Symbol: SNTB1
  Gene Name: syntrophin, beta 1 (dystrophin-associated protein A1, 59kDa, basic component 1)
  Uniprot ID: Q13884
  ENST ID: ENST00000517992
  CDS Start-End: 301-1917
cttgctttggggttttgcaactggctgctggcttttttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacttttccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgtt

SEQ ID NO: 188552 - DNA, 9789 bp, Homo sapiens
  Payload ID: 17097
  Gene Symbol: SNTB2
  Gene Name: syntrophin, beta 2 (dystrophin-associated protein A1, 59kDa, basic component 2)
  Uniprot ID: Q13425
  ENST ID: ENST00000336278
  CDS Start-End: 39-1661
gggcgggaagagggaagcgccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttattgcttaccaaatgtgcctttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttcttttttttttgagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggttttggttttgtttttttttgtctctctgactagctaaactgccaactagaagaatggttgttatgtagtaactcagaagaatcttttaataagtttcttcttttgtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtca

SEQ ID NO: 188553 - DNA, 415 bp, Homo sapiens
  Payload ID: 17097
  Gene Symbol: SNTB2
  Gene Name: syntrophin, beta 2 (dystrophin-associated protein A1, 59kDa, basic component 2)
  ENST ID: ENST00000360496
  CDS Start-End: 1-415
tcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggagtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgc

SEQ ID NO: 188554 - DNA, 536 bp, Homo sapiens
  Payload ID: 17097
  Gene Symbol: SNTB2
  Gene Name: syntrophin, beta 2 (dystrophin-associated protein A1, 59kDa, basic component 2)
  ENST ID: ENST00000525632
  CDS Start-End: 1-488
gcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggcaaaactagatggtggaagacagcaatggagacctgtcctcatggctgtgactgaga

SEQ ID NO: 188555 - DNA, 1489 bp, Homo sapiens
  Payload ID: 17097
  Gene Symbol: SNTB2
  Gene Name: syntrophin, beta 2 (dystrophin-associated protein A1, 59kDa, basic component 2)
  Uniprot ID: Q13425
  ENST ID: ENST00000467311
  CDS Start-End: 21-824
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaa

SEQ ID NO: 188556 - DNA, 149 bp, Homo sapiens
  Payload ID: 17097
  Gene Symbol: SNTB2
  Gene Name: syntrophin, beta 2 (dystrophin-associated protein A1, 59kDa, basic component 2)
  ENST ID: ENST00000577080
  CDS Start-End: 1-149
tcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggag

SEQ ID NO: 188557 - DNA, 186 bp, Homo sapiens
  Payload ID: 17097
  Gene Symbol: SNTB2
  Gene Name: syntrophin, beta 2 (dystrophin-associated protein A1, 59kDa, basic component 2)
  ENST ID: ENST00000574270
  CDS Start-End: 1-186
gcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggagg

SEQ ID NO: 188558 - DNA, 600 bp, Homo sapiens
  Payload ID: 17097
  Gene Symbol: SNTB2
  Gene Name: syntrophin, beta 2 (dystrophin-associated protein A1, 59kDa, basic component 2)
  ENST ID: ENST00000571655
  CDS Start-End: 21-600
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggagg

SEQ ID NO: 188559 - DNA, 618 bp, Homo sapiens
  Payload ID: 17097
  Gene Symbol: SNTB2
  Gene Name: syntrophin, beta 2 (dystrophin-associated protein A1, 59kDa, basic component 2)
  ENST ID: ENST00000571496
  CDS Start-End: 39-618
gggcgggaagagggaagcgccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggagg

SEQ ID NO: 188560 - DNA, 537 bp, Homo sapiens
  Payload ID: 17097
  Gene Symbol: SNTB2
  Gene Name: syntrophin, beta 2 (dystrophin-associated protein A1, 59kDa, basic component 2)
  ENST ID: ENST00000524887
  CDS Start-End: 1-194
gcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggagggcctataatgaggaaatttctgtctgaccaatatcaggggcacatcagctgctgtactaagtttcttcaaatatcctggaattgtgtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctg

SEQ ID NO: 188561 - DNA, 186 bp, Homo sapiens; identical to SEQ ID NO: 188557
  Payload ID: 17097
  Gene Symbol: SNTB2
  Gene Name: syntrophin, beta 2 (dystrophin-associated protein A1, 59kDa, basic component 2)
  ENST ID: ENST00000613835
  CDS Start-End: 1-186

SEQ ID NO: 188562 - DNA, 2773 bp, Homo sapiens
  Payload ID: 17098
  Gene Symbol: SNTG1
  Gene Name: syntrophin, gamma 1
  Uniprot ID: Q9NSN8
  ENST ID: ENST00000276467
  CDS Start-End: 42-1484
ctgtgtcttttcagacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtataagcaggacacatttactcatcattttagaccctagagaaaccataacatcaccaagtcgacagtggaggcaaatcaaaatttcggcagaaaaagaaggtcatgtggaacctcaaaaacacttctattctggatgacatctgtgaaatatactacatgaacagaacagcttgttctcactcagttgctttgtaccagtaagtgtattgctttcaccaaaagtggagacaaaagaataaattatttgaagaagtatgtaaataacataaaaatagtaagctacctatgaataaaaatacttattaaatgattacttctgtattttagattattttgtatgactagtacatgttgggcagagtcataggaaaacaaatgccctatcttgtattatgagggacataaaagagttaaaaaccataaatcagcaaggagcatgcaaaaaaatctcatcaaagaaggatgcactttaatttgctgatgtaaatttgcccttgtgttctcatcccatgatttgacactggcattccaattgtttttatcttattgtaaatattccgaagaacttccaaaggataattacattgacccatgatagatacaatgtgaaatggactattctcccttggatcactgttattgaaatgtcttattagctgccaaagtcaatcaaatatgccaacagtgtattaatttaattatgagtgatggaaaatttcatgaacctctcatttcttccttggtttgaaagagatttgtattttacctaataagatttattatcaaattaaagtttcataaattttcagtgaacccaaaaccttttgtagagaaaataatataaacaaatatggtgtgagaaacaattctttgtaatccgaagtctactagttaatcatgaactaaaatgtcccccgaaaacagtcccaaagctattatagatgttaattaaatgacattttttcattttagtactattttatgagaaacaaaggtgatatttaaagataaaagttaaaattctttaacctcccttgtcatggaaagtgattaagtaatgccaactatgcaggttgttttaggtattttgtcctaagaatgtaaatgtgaaaggctgggaaatttgaaagccttagaggtgtgcaatttactcagattccaggtattattcaactagttgtataacatggaacacagtctctgtccttcagtacagcttttttgagatattttaaaaagtcagctgtgtatg

SEQ ID NO: 188563 - DNA, 1714 bp, Homo sapiens
  Payload ID: 17098
  Gene Symbol: SNTG1
  Gene Name: syntrophin, gamma 1
  ENST ID: ENST00000520825
  CDS Start-End: 103-1149
actgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaagcctgtgtaactccaggttttcaccaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatga

SEQ ID NO: 188564 - DNA, 1925 bp, Homo sapiens
  Payload ID: 17098
  Gene Symbol: SNTG1
  Gene Name: syntrophin, gamma 1
  Uniprot ID: Q9NSN8
  ENST ID: ENST00000518864
  CDS Start-End: 372-1925
cccttccagccggagctcgcgagccgcggtggcggctggtggccaccccagggaaataaagccgttgctgctgcagcaaaatggctcaaagtccaaccaaagtctggccttttcctgagcctaggctgtgggcgactcgctagcactgccctgggcctccaagctgcctgctcgctgagctcagcgctgacactcacaggagctgcgttcgccggatcctctgagaggctctgcaacgatcccgatccaattcagcagcgttttaaaagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttga

SEQ ID NO: 188565 - DNA, 548 bp, Homo sapiens
  Payload ID: 17098
  Gene Symbol: SNTG1
  Gene Name: syntrophin, gamma 1
  ENST ID: ENST00000523085
  CDS Start-End: 272-548
aaatagctttgtgaaaagagggtggagagctactcaaaattctacgttagagagactgaaaagacatctaatttcattgctcggcagtgaacactggacacgttggtgggagttgttctgtgctgagagcatagcaatgaatacagagacagcagacctgccttcacagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagag

SEQ ID NO: 188566 - DNA, 3504 bp, Homo sapiens
  Payload ID: 17098
  Gene Symbol: SNTG1
  Gene Name: syntrophin, gamma 1
  Uniprot ID: Q9NSN8
  ENST ID: ENST00000522124
  CDS Start-End: 662-2215
ttaggggctcccgtccccttacttcagcaccagaggggatggacagcgtctccggactgagctgcagccacagggacggaactacgctgccgccgccgctgtccttgccgccactgtcgtcgccacgggcagctgggctacttgctcctcgcagctaaaaggcggtgcctcctattaccccctcgcctcccggcccccttccttaatggatgaaaagtacccctccctctacacctgctgtacctaaggacaggactctgaggagtactcttgctccacagattaaactctcagcagcaacttcaagaatcatttttctataggggtctgggaggaattctggaggagagtaaagtcgaagttcttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcagactgctctccagaatgttgagattgcccgagaagtgaccccagcaaaagaaaaatattgctgtacctaaattcaaacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtataagcaggacacatttactcatcattttagaccctagagaaaccataacatcaccaagtcgacagtggaggcaaatcaaaatttcggcagaaaaagaaggtcatgtggaacctcaaaaacacttctattctggatgacatctgtgaaatatactacatgaacagaacagcttgttctcactcagttgctttgtaccagtaagtgtattgctttcaccaaaagtggagacaaaagaataaattatttgaagaagtatgtaaataacataaaaatagtaagctacctatgaataaaaatacttattaaatgattacttctgtattttagattattttgtatgactagtacatgttgggcagagtcataggaaaacaaatgccctatcttgtattatgagggacataaaagagttaaaaaccataaatcagcaaggagcatgcaaaaaaatctcatcaaagaaggatgcactttaatttgctgatgtaaatttgcccttgtgttctcatcccatgatttgacactggcattccaattgtttttatcttattgtaaatattccgaagaacttccaaaggataattacattgacccatgatagatacaatgtgaaatggactattctcccttggatcactgttattgaaatgtcttattagctgccaaagtcaatcaaatatgccaacagtgtattaatttaattatgagtgatggaaaatttcatgaacctctcatttcttccttggtttgaaagagatttgtattttacctaataagatttattatcaaattaaagtttcataaattttcagtgaacccaaaaccttttgtagagaaaataatataaacaaatatggtgtgagaaacaattctttgtaatccgaagtctactagttaatcatgaactaaaatgtcccccgaaaacagtcccaaagctattatagatgttaattaaatgacattttttcattttagtactattttatgagaaacaaaggtgatatttaaagataaaagttaaaattctttaacctcccttgtcatggaaagtgattaagtaatgccaactatgcaggttgttttaggtattttgtcctaagaatgtaaatgtgaaaggctgggaaatttgaaagccttagaggtgtgcaatttactcagattccaggtattattcaactagttgtataacatggaacacagtctctgtccttcagtacagcttttttgagatattttaaaaagtcagctgtgtatg

SEQ ID NO: 188567 - DNA, 804 bp, Homo sapiens
  Payload ID: 17098
  Gene Symbol: SNTG1
  Gene Name: syntrophin, gamma 1
  ENST ID: ENST00000524004
  CDS Start-End: 1-361
gcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggtaatgtgttcaggtcagctctgagaaatatgctgcaaacattctaattgaagaatgatttaaatgcctcataactcctttcagcattttaattgtaatcgtgtcaaatttaagatcttcgtttttgttaatggaagataaattatgcttcgatctgaaaaaaagtttgaatttttaataaaacatatgtagtaccacaaaacta

SEQ ID NO: 188568 - DNA, 1703 bp, Homo sapiens
  Payload ID: 17098
  Gene Symbol: SNTG1
  Gene Name: syntrophin, gamma 1
  Uniprot ID: Q9NSN8
  ENST ID: ENST00000517473
  CDS Start-End: 223-1665
ttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcagacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtat

SEQ ID NO: 188569 - DNA, 2884 bp, Homo sapiens
  Payload ID: 17098
  Gene Symbol: SNTG1
  Gene Name: syntrophin, gamma 1
  Uniprot ID: Q9NSN8
  ENST ID: ENST00000620202
  CDS Start-End: 42-1595
ctgtgtcttttcagacgacatcctttgtggtgccacagcacatggatttcagaaccgcctgtgaggagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgaaagaacggtgaccatcagaagacaaacagtaggaggatttggattaagcataaagggaggagcagaacataacattccagttgtcgtttcaaaaatctccaaggaacaaagagcggaactttcaggactactttttattggagatgcaattctacagataaatggcattaatgtgagaaaatgtagacatgaagaagtggttcaggttcttcggaatgctggagaagaagtgactctaacagtgtcatttttaaaaagagcacctgctttcctcaaactcccattgaatgaagattgtgcatgtgctccaagtgaccagagcagtggcacctcctctcctctctgtgacagtggcttacatctcaactaccatcccaacaatacagacacattatcatgctcgtcgtggccgacgtctccaggcttgaggtgggagaagcgatggtgcgacctcagactgatccctctacttcattcgcgcttctctcagtatgtgcccggcacagatttgagtcggcagaatgcctttcaagtcattgctgtggatggggtctgcactgggattattcagtgcctctctgctgaagactgcgttgactggctacaagcaatagcaactaacatttcaaatctcacaaagcacaatattaaaaaaatcaacagaaactttcctgtaaaccagcagattgtctacatgggctggtgtgaagcccgggagcaagaccccctccaggacagagtgtactccccgaccttcctggccctgaggggctcatgtctctacaagtttctggcacctccagtgaccacctgggactggacgagagcagagaaaacattctcagtttatgagattatgtgcaagatcctcaaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacagtgcaagacctatgcatgtgtgctagaaagtcatctaatgggactcacaattgatttcagcacaggatttatctgctttgatgctgcaacaaaggctgtcctttggaggtataaattctctcagcttaaaggttcttcagatgatggcaagagcaaaatcaaatttttgtttcagaatccagatactaaacagattgaagcaaaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtataagcaggacacatttactcatcattttagaccctagagaaaccataacatcaccaagtcgacagtggaggcaaatcaaaatttcggcagaaaaagaaggtcatgtggaacctcaaaaacacttctattctggatgacatctgtgaaatatactacatgaacagaacagcttgttctcactcagttgctttgtaccagtaagtgtattgctttcaccaaaagtggagacaaaagaataaattatttgaagaagtatgtaaataacataaaaatagtaagctacctatgaataaaaatacttattaaatgattacttctgtattttagattattttgtatgactagtacatgttgggcagagtcataggaaaacaaatgccctatcttgtattatgagggacataaaagagttaaaaaccataaatcagcaaggagcatgcaaaaaaatctcatcaaagaaggatgcactttaatttgctgatgtaaatttgcccttgtgttctcatcccatgatttgacactggcattccaattgtttttatcttattgtaaatattccgaagaacttccaaaggataattacattgacccatgatagatacaatgtgaaatggactattctcccttggatcactgttattgaaatgtcttattagctgccaaagtcaatcaaatatgccaacagtgtattaatttaattatgagtgatggaaaatttcatgaacctctcatttcttccttggtttgaaagagatttgtattttacctaataagatttattatcaaattaaagtttcataaattttcagtgaacccaaaaccttttgtagagaaaataatataaacaaatatggtgtgagaaacaattctttgtaatccgaagtctactagttaatcatgaactaaaatgtcccccgaaaacagtcccaaagctattatagatgttaattaaatgacattttttcattttagtactattttatgagaaacaaaggtgatatttaaagataaaagttaaaattctttaacctcccttgtcatggaaagtgattaagtaatgccaactatgcaggttgttttaggtattttgtcctaagaatgtaaatgtgaaaggctgggaaatttgaaagccttagaggtgtgcaatttactcagattccaggtattattcaactagttgtataacatggaacacagtctctgtccttcagtacagcttttttgagatattttaaaaagtcagctgtgtatg

SEQ ID NO: 188570 - DNA, 1888 bp, Homo sapiens
  Payload ID: 17099
  Gene Symbol: SNTG2
  Gene Name: syntrophin, gamma 2
  Uniprot ID: Q9NY99
  ENST ID: ENST00000308624
  CDS Start-End: 130-1749
gcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgaccaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagacgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacatgtcactagtttccaaa

SEQ ID NO: 188571 - DNA, 1436 bp, Homo sapiens
  Payload ID: 17099
  Gene Symbol: SNTG2
  Gene Name: syntrophin, gamma 2
  Uniprot ID: Q9NY99
  ENST ID: ENST00000407292
  CDS Start-End: 59-1297
ggggtcctggcgttgagctcggccggcccggagcgcggacccagccgcaggggcggcgatgggcaccgagggacccccgcccccggccgcctcccgcggacgccagggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatgccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgaccaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagacgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacatgtcactagtttccaaa

SEQ ID NO: 188572 - DNA, 666 bp, Homo sapiens
  Payload ID: 17099
  Gene Symbol: SNTG2
  Gene Name: syntrophin, gamma 2
  ENST ID: ENST00000450962
  CDS Start-End: 130-519
gcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagatggagtcttgctctgtcgcccaggctggagtgcagtgctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttag

SEQ ID NO: 188573 - DNA, 1818 bp, Homo sapiens
  Payload ID: 17099
  Gene Symbol: SNTG2
  Gene Name: syntrophin, gamma 2
  ENST ID: ENST00000452177
  CDS Start-End: 130-519
gcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagatggagtcttgctctgtcgcccaggctggagtgcagtgctgaccagacagggatgttgttcgtaggagatgctgttctccaggttaatggcatacatgtagaaaatgcaactcatgaagaagtgctgcgttgacccgaggctgctgtgtgtagaatcatgtgttgtgctcttctctgctcccctggaagcctccgtcaacaggtcgagtttgcgactccacggagaaactgcactgatgtcaccaacttcgtgtcctgggctactcaccagcccatttcggactggactttgtgtccccccagattcacatgtcgaagccctaacccctaaatgagggcgtcaggagacagagacggggcctctggaagtgactagggtgagaggaggtgatgaagatggcatcctggtgatgggatcagtgcctgcaagaagaagccctctggagcgcacttcctctctccaccacgcaaggacacagccagaaggccaggccctcaccaggaaggatctggcaccttgctcgcacctgatcacagactcccagcctctggaattccgaggaaggaacctctgctgctgagaagccacccaggcatggctaagctgactcaaacaccgcagtgaatccaatggcttcagagtcattttacaggtgttgggagatttcatttcatagttgactcctttctaaggaagaaatggacttggcttacctgtcagagtttgacatgctggtgaattggaggttggaacgcatcctcctaccttgactttgtcggcgcagagcaggtgtgcactgtaatgggagctgcaggtggaaatggggagaggccaggcatggtggctcacgcttgtaatcccagcactacggggccaaggcgggaggatcacttgagtccagaaggccaagtctgcagtgagctatgattgcaccactgccttccagcctggatgacagtcaaaaaaaaagagagcgcatctagacttttagtgtctcaatcaaatttaaacaatggcaaatacattgtgcacaaaaaagctgcttttagatgctgtgttgagagagagagagatagagagagagacagaaaaggggaaagcctccaggccatggctactggtgttaatttgctgcaaaaagcagtgactgctgctgtgggctgaaggaggctgccccctaggcaggtgtgggccagggtctctcccagtgccgtcaggcttagggccatgattccaggagggagaaatctttgaaggcattggttgaattcagtagcatcaatggtcaacattcaattattttgttcatacaccacatatatgcttcaaactaaataaaaaataagactgataacaaattgaa

SEQ ID NO: 188574 - DNA, 382 bp, Homo sapiens
  Payload ID: 17099
  Gene Symbol: SNTG2
  Gene Name: syntrophin, gamma 2
  ENST ID: ENST00000627321
  CDS Start-End: 1-243
aatgtgctctggagatttaaattttcccagcttaagggatcttcagatgatgggaaaactcgagtaaagctgctgtttcagaatctggacaccaaacagattgagatgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacatgtcactagtttccaaa

SEQ ID NO: 188575 - DNA, 693 bp, Homo sapiens
  Payload ID: 17099
  Gene Symbol: SNTG2
  Gene Name: syntrophin, gamma 2
  ENST ID: ENST00000627224
  CDS Start-End: 1-693
gccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgaccaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccggg

SEQ ID NO: 188576 - DNA, 382 bp, Homo sapiens; identical to SEQ ID NO: 188574
  Payload ID: 17099
  Gene Symbol: SNTG2
  Gene Name: syntrophin, gamma 2
  ENST ID: ENST00000625507
  CDS Start-End: 1-243

SEQ ID NO: 188577 - DNA, 3041 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000336904
  CDS Start-End: 90-512
gggaggagcttgcttctccattctggtgtgatccaggaacagctgtcttccagctctgaaagagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 188578 - DNA, 1096 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000345009
  CDS Start-End: 14-352
gaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattc

SEQ ID NO: 188579 - DNA, 1420 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000394986
  CDS Start-End: 423-845
agagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaata

SEQ ID NO: 188580 - DNA, 3167 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000394989
  CDS Start-End: 264-644
aggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatg

SEQ ID NO: 188581 - DNA, 1290 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000394991
  CDS Start-End: 293-715
gacaaatcagcggtgggggcggagagccgaggagaaggagaaggaggaggactaggaggaggaggacggcgacgaccagaaggggcccaagagagggggcgagcgaccgagcgccgcgacgcggaagtgaggtgcgtgcgggctgcagcgcagaccccggcccggcccctccgagagcgtcctgggcgctccctcacgccttgccttcaagccttctgcctttccaccctcgtgagcggagaactgggagtggccattcgacgacagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaata

SEQ ID NO: 188582 - DNA, 3127 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000420646
  CDS Start-End: 260-598
gccattcgacgacaggttagcgggtttgcctcccactcccccagcctcgcgtcgccggctcacagcggcctcctctggggacagtcccccccgggtgccgcctccgcccttcctgtgcgctccttttccttcttctttcctattaaatattatttgggaattgtttaaattttttttttaaaaaaagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 188583 - DNA, 411 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000505199
  CDS Start-End: 19-399
taaaggaattcattagccatggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttg

SEQ ID NO: 188584 - DNA, 570 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000506244
  CDS Start-End: 97-519
ggaggacggcgacgaccagaaggggcccaagagagggggcgagcgaccgagcgccgcgacgcggaagtgagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcc

SEQ ID NO: 188585 - DNA, 387 bp, Homo sapiens
  Payload ID: 17100
  Gene Symbol: SNCA
  Gene Name: synuclein, alpha (non A4 component of amyloid precursor)
  ENST ID: ENST00000506691
  CDS Start-End: 188-387
gaccccggcccggcccctccgagagcgtcctgggcgctccctcacgccttgccttcaagccttctgcctttccaccctcgtgagcggagaactgggagtggccattcgacgacagagagaggcggggaggagtcggagttgtggagaagcagagggactcagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttgg

SEQ ID NO: 188586 - DNA, 731 bp, Homo sapiens
  Payload ID: 17100
  Gene Symbol: SNCA
  Gene Name: synuclein, alpha (non A4 component of amyloid precursor)
  ENST ID: ENST00000502987
  CDS Start-End: 29-376
cagtgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggtatggctgtgtacgttttgtgttacatttataagctggtgagattacggttcattttcatgtgaggcctggaggcaggagcaagatacttactgtggggaacggctacctgaccctccccttgtgaaaaagtgctacctttatattggtcttgcttgtttcaggcattaacccagataaatgccatgcaaattttataattattatgattgtttcaatttctggaagaaagttaatgaaacaaaaaatgtagtaaaatgccaaaggaacagtgacatttcagaaagaatgagggctttcatgttaattgtaagtcttggaatttctcttccttggagtaacaaatccctttgtgcctaatttcctaatttccaaaataaagttcttttacttattt

SEQ ID NO: 188587 - DNA, 905 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000508895
  CDS Start-End: 113-535
gatagctgagggcgggggtggatgttggatggattagaaccatcacacttgggcctgctgtttgcctgagtttgaaccacaccccgatgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtaggctccaaaaccaaggagggagtggtgcatggtgtggcaacagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagattttta

SEQ ID NO: 188588 - DNA, 297 bp, Homo sapiens
  Payload ID: 17100
  Gene Symbol: SNCA
  Gene Name: synuclein, alpha (non A4 component of amyloid precursor)
  ENST ID: ENST00000611107
  CDS Start-End: 1-297
atggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaaggaagggtatcaagactacgaacctgaagcctaa

SEQ ID NO: 188589 - DNA, 3022 bp, Homo sapiens
  Payload ID: 17100
  Gene Symbol: SNCA
  Gene Name: synuclein, alpha (non A4 component of amyloid precursor)
  Uniprot ID: P37840
  ENST ID: ENST00000618500
  CDS Start-End: 113-493
gatagctgagggcgggggtggatgttggatggattagaaccatcacacttgggcctgctgtttgcctgagtttgaaccacaccccgatgtggtgtaaaggaattcattagccatggatgtattcatgaaaggactttcaaaggccaaggagggagttgtggctgctgctgagaaaaccaaacagggtgtggcagaagcagcaggaaagacaaaagagggtgttctctatgtagtggctgagaagaccaaagagcaagtgacaaatgttggaggagcagtggtgacgggtgtgacagcagtagcccagaagacagtggagggagcagggagcattgcagcagccactggctttgtcaaaaaggaccagttgggcaagaatgaagaaggagccccacaggaaggaattctggaagatatgcctgtggatcctgacaatgaggcttatgaaatgccttctgaggaagggtatcaagactacgaacctgaagcctaagaaatatctttgctcccagtttcttgagatctgctgacagatgttccatcctgtacaagtgctcagttccaatgtgcccagtcatgacatttctcaaagtttttacagtgtatctcgaagtcttccatcagcagtgattgaagtatctgtacctgcccccactcagcatttcggtgcttccctttcactgaagtgaatacatggtagcagggtctttgtgtgctgtggattttgtggcttcaatctacgatgttaaaacaaattaaaaacacctaagtgactaccacttatttctaaatcctcactatttttttgttgctgttgttcagaagttgttagtgatttgctatcatatattataagatttttaggtgtcttttaatgatactgtctaagaataatgacgtattgtgaaatttgttaatatatataatacttaaaaatatgtgagcatgaaactatgcacctataaatactaaatatgaaattttaccattttgcgatgtgttttattcacttgtgtttgtatataaatggtgagaattaaaataaaacgttatctcattgcaaaaatattttatttttatcccatctcactttaataataaaaatcatgcttataagcaacatgaattaagaactgacacaaaggacaaaaatataaagttattaatagccatttgaagaaggaggaattttagaagaggtagagaaaatggaacattaaccctacactcggaattccctgaagcaacactgccagaagtgtgttttggtatgcactggttccttaagtggctgtgattaattattgaaagtggggtgttgaagaccccaactactattgtagagtggtctatttctcccttcaatcctgtcaatgtttgctttacgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaataaaaaaaaaaaaaaagtgggttcccgggaactaagcagtgtagaagatgattttgactacaccctccttagagagccataagacacattagcacatattagcacattcaaggctctgagagaatgtggttaactttgtttaactcagcattcctcactttttttttttaatcatcagaaattctctctctctctctctctttttctctcgctctctttttttttttttttttacaggaaatgcctttaaacatcgttggaactaccagagtcaccttaaaggagatcaattctctagactgataaaaatttcatggcctcctttaaatgttgccaaatatatgaattctaggatttttccttaggaaaggtttttctctttcagggaagatctattaactccccatgggtgctgaaaataaacttgatggtgaaaaactctgtataaattaatttaaaaattatttggtttctctttttaattattctggggcatagtcatttctaaaagtcactagtagaaagtataatttcaagacagaatattctagacatgctagcagtttatatgtattcatgagtaatgtgatatatattgggcgctggtgaggaaggaaggaggaatgagtgactataaggatggttaccatagaaacttccttttttacctaattgaagagagactactacagagtgctaagctgcatgtgtcatcttacactagagagaaatggtaagtttcttgttttatttaagttatgtttaagcaaggaaaggatttgttattgaacagtatatttcaggaaggttagaaagtggcggttaggatatattttaaatctacctaaagcagcatattttaaaaatttaaaagtattggtattaaattaagaaatagaggacagaactagactgatagcagtgacctagaacaatttgagattaggaaagttgtgaccatgaatttaaggatttatgtggatacaaattctcctttaaagtgtttcttcccttaatatttatctgacggtaatttttgagcagtgaattactttatatatcttaatagtttatttgggaccaaacacttaaacaaaaagttctttaagtcatataagccttttcaggaagcttgtctcatattcactcccgagacattcacctgccaagtggcctgaggatcaatccagtcctaggtttattttgcagacttacattctcccaagttattcagcctcatatgactccacggtcggctttaccaaaacagttcagagtgcactttggcacacaattgggaacagaacaatctaatgtgtggtttggtattccaagtggggtctttttcagaatctctgcactagtgtgagatgcaaacatgtttcctcatctttctggcttatccagtatgtagctatttgtgacataataaatatatacatatatgaaaata

SEQ ID NO: 188590 - DNA, 4986 bp, Homo sapiens
  Payload ID: 17101
  Gene Symbol: SNCAIP
  Gene Name: synuclein, alpha interacting protein
  Uniprot ID: Q9Y6H5
  ENST ID: ENST00000261367
  CDS Start-End: 1429-4479
gctcctgccgctgcggtccgtcggtcggtcagtcagtcccttcgcgctcctgagccgccggcgcgccgggcgccccggaaaagagtgcctgagagtgccagaggcttggtggaagggcagacgagagaagaggaggcattgtattggccactgggacaactgcagactcactcttacctgtaaagaagcagttaatgttggggaatgtagtcaggattggaaaaccacggggatttctgcacattataattgagaatgtaaatattcttaaagtggcaccctgaaagagacaagcattgaaaccagacaaaataaattggatcatgaacagaatgagacatcttaaaggagatagcatgtggaggcctgctgggaagtagaggcaaattccagatgcctaggagccttagtctaaggtggggccatccaacccacagaaataaatatgggcagtggcccaagacttcctataatgagctgcacctgttgtaagtcttgtgttcttgcctatagaataaagaacctcactaccatcctgcaagtgcaaattgaaagattcctgttgtgatgccatgagttattatccgctggttatattctattggaatggctacactcaactggatattgctgtctatattgttggagcacctcaaacaggggtgcaatggttatttgttaatttacttaattaagacatgttcatccacattttatagtttcatttatttaaagatccatttggtccccagcttcgatgcatgtttctctgcttcatctccccatatttccatgttcctgctgatgtttataccatatcctggcacccagcatcatctgtgtgttgttcaccaaggccgtgggaacagagtctgtaaatcaatagttcatcacggagtacagatttcatgaaaagaaattggattggaagaaagtctcctagtgaacacgctagtatccaaagagtctggattgtatcagaatccatcacagtaggagagaatgttgttttgagtaatttccaagcagagtacatatattttcctctgaaaatctttgtaaattgaagaaaagtgacatttttataccaagcaatttgtttgataacctattttcagatttctacaaataataaaatttctgattttaaatattttttacaaatacaagttggttttcttttcattgtaagccttactgtgatttcagaagaatttttaacatttgctaaatggataatctcatttaaacatggaagtaacatcctaatcctttcttggatggactctgtatctattgtaattaagactttaaaaatggtatatacatatgggaaaaaaaggagaggaaacaggaaaattaaatcaagtgatgggtttgaggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttct

SEQ ID NO: 188591 - DNA, 3745 bp, Homo sapiens
  Payload ID: 17101
  Gene Symbol: SNCAIP
  Gene Name: synuclein, alpha interacting protein
  Uniprot ID: Q9Y6H5
  ENST ID: ENST00000261368
  CDS Start-End: 263-3022
gcggccgcccaggctgcccccgcccgcgcgcgcccgttggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggactttgcaagtattttgattgctgatatttgatttcaggaacaaactgctcagtttagcagttttcccataggcgtcaaataaaacattctatatttcattaagta

SEQ ID NO: 188592 - DNA, 2588 bp, Homo sapiens
  Payload ID: 17101
  Gene Symbol: SNCAIP
  Gene Name: synuclein, alpha interacting protein
  Uniprot ID: Q9Y6H5
  ENST ID: ENST00000379538
  CDS Start-End: 253-2064
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 188593 - DNA, 1888 bp, Homo sapiens
  Payload ID: 17101
  Gene Symbol: SNCAIP
  Gene Name: synuclein, alpha interacting protein
  ENST ID: ENST00000395466
  CDS Start-End: 1-267
atggaagcccctgaataccttgatttggatgaaattgactttagtgatgacatatcttattcagtcacatcactcaagacgatcccagaactgtgccgaagatgtgatacgcaaaacgaagacagatcagccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 188594 - DNA, 3126 bp, Homo sapiens
  Payload ID: 17101
  Gene Symbol: SNCAIP
  Gene Name: synuclein, alpha interacting protein
  Uniprot ID: Q9Y6H5
  ENST ID: ENST00000395469
  CDS Start-End: 1-1767
atggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagactagactcaagattcaagggacttggaatgggagtgagacatgcctttttacacaccactttagctcctatccccctatctcttctgggctgcagtgtcaaggacaagaaggagttctttttattcctgatcaggttggcgcagcaacaaataaacaggtgttatttcaaaaccaattaccagagaccaaatccagttactagagcccaagcaaatgagaacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 188595 - DNA, 1591 bp, Homo sapiens
  Payload ID: 17101
  Gene Symbol: SNCAIP
  Gene Name: synuclein, alpha interacting protein
  ENST ID: ENST00000414317
  CDS Start-End: 1-189
atggaagcccctgaataccttgatttggatgaaattgactttagtgatgacatatcttattcagtcacatcactcaagacgatcccagaactgtgccgaagatgtgatacgcaaaacgaagacagatcaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagta

SEQ ID NO: 188596 - DNA, 2807 bp, Homo sapiens
  Payload ID: 17101
  Gene Symbol: SNCAIP
  Gene Name: synuclein, alpha interacting protein
  ENST ID: ENST00000509154
  CDS Start-End: 234-2807
aaaaagagcgaaaggtaaagaaagagcaggttcgtggacaggagccggcgggcaggccgggggatccctgagacagggtttcaccatgttgcccaggctggtctcgaactcctggactcaagcagtctgtccatctcagcctcccaaagtgctgggattacaggtgtgagccaccacactggccaaggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgagcccagcacatcgctgggtgaactggagcactacgacctcgacatggatgagattctggatgtgccttatattaaatccagtcagcagcttgcctcttttaccaaggtgacttcagaaaaaagaattttgggcttatgcacaaccatcaatggcctttctggcaaagcctgctctacaggaagttctgagagctcatcatccaacatggcaccattttgtgttctttctcccgtgaaaagccctcacttgagaaaagcatcagctgtcatccacgaccagcacaagctgtccactgaagaaaccgagatctcacctcctctggttaaatgtggctctgcatatgagcctgaaaaccagagtaaagacttcctaaacaagacatttagtgatcctcatggtcgaaaagttgagaagacaacaccagactgccagctcagggccttccacctacaatcctcagcagcagaatccaaaccagaagagcaggtcagtggcctaaaccggaccagctcccaaggcccagaagaaaggagtgagtatctgaaaaaagtgaaaagcatcttgaacattgttaaagaaggacagatctctctcctgaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggca

SEQ ID NO: 188597 - DNA, 420 bp, Homo sapiens
  Payload ID: 17101
  Gene Symbol: SNCAIP
  Gene Name: synuclein, alpha interacting protein
  ENST ID: ENST00000508681
  CDS Start-End: 126-420
agtcgaggtaaaaagagcgaaaggtaaagaaagagcaggttcgtggacaggagccggcgggcaggccgggggatccctggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaaga

SEQ ID NO: 188598 - DNA, 1849 bp, Homo sapiens
  Payload ID: 17101
  Gene Symbol: SNCAIP
  Gene Name: synuclein, alpha interacting protein
  ENST ID: ENST00000512146
  CDS Start-End: 1-342
atggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 188599 - DNA, 2410 bp, Homo sapiens
  Payload ID: 17101
  Gene Symbol: SNCAIP
  Gene Name: synuclein, alpha interacting protein
  ENST ID: ENST00000508017
  CDS Start-End: 83-283
cgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgttctgatttctaagggact

SEQ ID NO: 188600 - DNA, 468 bp, Homo sapiens
  Payload ID: 17101
  Gene Symbol: SNCAIP
  Gene Name: synuclein, alpha interacting protein
  ENST ID: ENST00000514497
  CDS Start-End: 266-468
gcctacttcggctgaggctgttctgctcctgccgctgcggtccgtcggtcggtcagtcagtcccttcgcgctcctgagccgccggcgcgccgggcgccccggagacagggtttcaccatgttgcccaggctggtctcgaactcctggactcaagcagtctgtccatctcagcctcccaaagtgctgggattacaggtgtgagccaccacactggccaaggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattc

SEQ ID NO: 188601 - DNA, 2564 bp, Homo sapiens
  Payload ID: 17101
  Gene Symbol: SNCAIP
  Gene Name: synuclein, alpha interacting protein
  ENST ID: ENST00000512385
  CDS Start-End: 207-407
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacct

SEQ ID NO: 188602 - DNA, 2359 bp, Homo sapiens
  Payload ID: 17101
  Gene Symbol: SNCAIP
  Gene Name: synuclein, alpha interacting protein
  ENST ID: ENST00000510658
  CDS Start-End: 139-339
aaagtgggaagcgcggacaaaaagtaggcggggaggagaggagagccccagctggggaaaagcaacggcagtcgaggtaaaaagagcgaaaggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccagtcagagattcaaggattttcaattcacatctgaatgagaattttctcttgctacggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcag

SEQ ID NO: 188603 - DNA, 586 bp, Homo sapiens
  Payload ID: 17101
  Gene Symbol: SNCAIP
  Gene Name: synuclein, alpha interacting protein
  ENST ID: ENST00000506272
  CDS Start-End: 105-586
agctggggaaaagcaacggcagtcgaggtaaaaagagcgaaaggtaaagaaagagcaggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctggg

SEQ ID NO: 188604 - DNA, 1885 bp, Homo sapiens
  Payload ID: 17101
  Gene Symbol: SNCAIP
  Gene Name: synuclein, alpha interacting protein
  ENST ID: ENST00000504884
  CDS Start-End: 1-267
atggaagcccctgaataccttgatttggatgaaattgactttagtgatgacatatcttattcagtcacatcactcaagacgatcccagaactgtgccgaagatgtgatacgcaaaacgaagacagatcagccacacctagctgcagacaatctagacaaaattcacgacgaaaatggaaacaatctattacatattgcggcgtcacagggacacgcagagtgtctacagcacctcacttctttgatgggagaagactgcctcaatgagcgcaacactgagaagttgactccagcaggcctggccattaagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagta

SEQ ID NO: 188605 - DNA, 1972 bp, Homo sapiens
  Payload ID: 17101
  Gene Symbol: SNCAIP
  Gene Name: synuclein, alpha interacting protein
  ENST ID: ENST00000509023
  CDS Start-End: 95-283
agtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatg

SEQ ID NO: 188606 - DNA, 723 bp, Homo sapiens
  Payload ID: 17101
  Gene Symbol: SNCAIP
  Gene Name: synuclein, alpha interacting protein
  ENST ID: ENST00000514467
  CDS Start-End: 319-723
gagcacagaacattccaggcaggcaaagccacccttgccctcctctccttggccacgtcctcaggggtgggcgagcttcggggggaggggtgggggtgaagactccgtgccaacgcaaaatactctgccaaaaggcttctcagacatgagtttcccagggcaatgcccaccttccgttccccgccttcccgagtctcttctcccagtttatgctggaaccctggaatggtctggggaccaatgagatggcagcggttaacgcttggatcacggaatttataagtatttgaccgtactcaaaatgtgcaaggaagaataatggaagcccctgaataccttgatttggatgaaattgactttagtgatgacatatcttattcagtcacatcactcaagacgatcccagaactgtgccgaagatgtgatacgcaaaacgaagacagatcagtttctagctctagctggaattgtggcatctcaactcttattacaaacacgcaaaagcccacaggaatcgctgatgtgtacagtaagttccgcccagtgaagcgggtttcgccactgaaacatcagccagagactctggagaacaatgaaagtgatgaccaaaagaaccagaaagtggttgagtaccagaaagggggtgagtctgacctgggcccccagcctcaggagcttggccctggagatggagtgggcggcccaccaggtaagagctctgag

SEQ ID NO: 188607 - DNA, 1708 bp, Homo sapiens
  Payload ID: 17101
  Gene Symbol: SNCAIP
  Gene Name: synuclein, alpha interacting protein
  ENST ID: ENST00000515215
  CDS Start-End: 1-201
atggaagcccctgaataccttgatttggatgaaattgactttagtgatgacatatcttattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagcataa

SEQ ID NO: 188608 - DNA, 559 bp, Homo sapiens
  Payload ID: 17101
  Gene Symbol: SNCAIP
  Gene Name: synuclein, alpha interacting protein
  ENST ID: ENST00000509652
  CDS Start-End: 518-559
attgttcttttcatttgcccgcctcatgtggttcttattcttgctgtcacccgggatcttatcgcaggcagggatgggcagttccgcggctcggaaaagctgagataaggaggggcgaagtaatagtaatagcgacagtactaacaacggtaataatagctgtagaaaagggacgtctggtgttgctgccgcccctcgctcatcagcaccagctccccgactgccctgtccagcccgggctccgccagcctccctctagtgctgttctgcgtcccaggctggtccgcgtggatttcagaggggaatgtttctctcttggccttgtctcttggcgatgactttcatctgcaggtgagacagggtttcaccatgttgcccaggctggtctcgaactcctggactcaagcagtctgtccatctcagcctcccaaagtgctgggattacaggtgtgagccaccacactggccaaggaatttataagtatttgaccgtactcaaaatgtgcaaggaagaataatggaagcccctgaataccttgatttggatgaaattgacttt

SEQ ID NO: 188609 - DNA, 2729 bp, Homo sapiens
  Payload ID: 17101
  Gene Symbol: SNCAIP
  Gene Name: synuclein, alpha interacting protein
  ENST ID: ENST00000542191
  CDS Start-End: 207-548
cgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggaatttataagtatttgaccgtactcaaaatgtgcaaggaagaataatggaagcccctgaataccttgatttggatgaaattgactttagtgatgacatatctgacaataggagtcaagggaacaggctacaaaagcttggattggaggacacagacagggaagatgcaatgggctttggttcccatagggccaaactgacagtagttgctgccctgggagcttgccattgtcctgagaatgagtattcagtcacatcactcaagacgatcccagaactgtgccgaagatgtgatacgcaaaacgaagacagatcagaatggtcagttggagtgcgtacgctggatggtgagcgaaacagaagccattgcagaactgagttgttctaaggattttccaagccttattcattacgcaggttgctatggccaggaaaagattcttctgtggcttcttcagtttatgcaagaacagggcatctcgttggatgaagtagaccaggatggcaacagtgccgttcacgtagcctcacagcatggctaccttggatgcatacagaccttggttgaatatggagcaaatgtcaccatgcagaaccacgctggggaaaagccctcccagagcgccgagcggcaggggcacaccctgtgctccaggtacctggtggtggtggagacctgcatgtcgctggcctctcaagtggtgaagttaaccaagcagctaaaggaacaaacagtagaacgtgtcacgctgcagaaccaactccaacaatttctagaagcccagaaatcagagggcaagtcactcccttcttcacccagttcaccatcctcacctgcctccagaaagtcccagtggaaatctccagatgcagatgatgattctgtagccaaaagcaagccaggagtccaagaggggattcaggttcttggaagcctgtcagcctccagccgggctagacccaaagcaaaagatgaagattctgataaaatcttacgccagttattgggaaaggaaatctcagaaaatgtctgcacccaggaaaaactgtccttggaattccaggatgctcaggcttcctctagaaattctaaaaagatcccactggagaagagggaactgaagttagccaggctgagacagctgatgcagaggtcactgagtgagtctgacacagactccaacaactctgaggaccccaagactaccccagtgaggaaggctgaccgaccaaggccgcagcccattgtagaaagcgtagagagtatggacagcgcagaaagcctgcacctgatgattaagaaacacaccttggcatcagggggacgcaggtttcctttcagcatcaaggcctccaaatccctggatggccacagcccatctcccacctcagagagcagcgaaccagacttagaatcccagtatccaggctcagggagtattcctccaaaccagccctctggtgaccctcagcagcccagccctgacagtactgctgcccagaaagttgccacaagtcccaagagtgccctcaagtctccatcttccaagcgtaggacatctcagaacttaaaactgagagttacctttgaggagcctgtggtgcagatggagcagcctagccttgaactgaatggagaaaaagacaaagataagggcaggactctccagcggacctccacaagtaacgaatcgggggatcaactgaaaaggccttttggagcctttcgatctatcatggagacactaagtggcaaccaaaacaataataataactaccaggcagccaaccagctgaaaacctctacattgcccttgacctcacttgggaggaagacagatgccaagggaaaccctgccagctccgctagcaaaggaaagaataaggcagaaatgtacagcagctgcatcaatctttcctctaacatgctgattgaagagcatctgtgtaacgacacacggcataatgacatcaatagaaaaatgaagaaatcctacagcataaagcacattgctgagccagagtcaaaagaactcttcttgtaaatcactttttaaattttctctcactgatgccctttggaaattattggaaatttctggactatcctctttggaaagagaaccatgaaaacaatgcctcaccagcagaagaacagaatatcaggatgccttaaatttatagtagtagactgtaaaagattcattttggggtgatatctgtatatataacttgtttttttaaaagatgccgtttaaaagcatgattgggaaaatgtatgttttttaagagtagattgattcaccctacccacaggacattcaccaagccactgataccattttatatttcatcaattgcatgagtatttgctaatgttgattgaacctccctttccccataatgtgggcagatttggctcagctccttcatgagatcaggtcagtggtattgtttctgtcaagagtgttttttctgtcatttctactttttgtataaaggaaataaaacaatgttaacagccacctataagcttggggcacctactttctaacaaatctgtgatgtt

SEQ ID NO: 188610 - DNA, 1383 bp, Homo sapiens
  Payload ID: 17102
  Gene Symbol: SNCB
  Gene Name: synuclein, beta
  Uniprot ID: Q16143
  ENST ID: ENST00000310112
  CDS Start-End: 252-656
ggtccaccccggcctggcctagcggagcccccgcgtccgcccgccgcagccgccgctccatccccagccccggccccgcatccaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgcccccgagagtccatgaataaagctaatctgtctgtagccagagccgcaccggcagggctgggctgggcgccgggtgggggcgacacgtggcggcgagtcttccaggtcccagcctacccctctgtgctctttggggtctggcacacacagcccaggtacaa

SEQ ID NO: 188611 - DNA, 1234 bp, Homo sapiens
  Payload ID: 17102
  Gene Symbol: SNCB
  Gene Name: synuclein, beta
  Uniprot ID: Q16143
  ENST ID: ENST00000393693
  CDS Start-End: 260-664
tgccgcagcgccggagccggagccggagccggagcgcgcgagctcgcagggcgcgaggaacgagcggtggctggctacgcacccgagacccgggcactgctgcgctcctgctcaggacccgcgacccgagcgcctgatcccggccctatcccccctccggcccctggtccaccccggcctggcctagcggagcccccgcgtccgcccgccgcagccgccgctccatccccagccccggccccgcatccaggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgccccc

SEQ ID NO: 188612 - DNA, 552 bp, Homo sapiens
  Payload ID: 17102
  Gene Symbol: SNCB
  Gene Name: synuclein, beta
  Uniprot ID: Q16143
  ENST ID: ENST00000506696
  CDS Start-End: 122-526
gtgcatgaccgtgtgactgtgccgtgcgtgtacaggcgggtcctggatattcgcgccgaacccagcactccggttcgacggggctgcagtttgcagggcccggataaccgaggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcag

SEQ ID NO: 188613 - DNA, 730 bp, Homo sapiens
  Payload ID: 17102
  Gene Symbol: SNCB
  Gene Name: synuclein, beta
  Uniprot ID: Q16143
  ENST ID: ENST00000510387
  CDS Start-End: 196-600
gaccgtgtgactgtgccgtgcgtgtacaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccct

SEQ ID NO: 188614 - DNA, 1407 bp, Homo sapiens
  Payload ID: 17102
  Gene Symbol: SNCB
  Gene Name: synuclein, beta
  ENST ID: ENST00000614675
  CDS Start-End: 444-806
cgccagcgggggcgctgagctcagagctgccgcagcgccggagccggagccggagccggagcgcgcgagctcgcagggcgcgaggaacgagcggtggctggctacgcacccgagacccgggcactgctgcgctcctgctcaggacccgcgacccgagcgcctgatcccggccctatcccccctccggcccctggtccaccccggcctggcctagcggagcccccgcgtccgcccgccgcagccgccgctccatccccagccccggccccgcatccaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcgtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgcccccgagagtccatgaataaagctaatctgtctgt

SEQ ID NO: 188615 - DNA, 684 bp, Homo sapiens
  Payload ID: 17103
  Gene Symbol: SNCG
  Gene Name: synuclein, gamma (breast cancer-specific protein 1)
  ENST ID: ENST00000348795
  CDS Start-End: 69-449
caagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccct

SEQ ID NO: 188616 - DNA, 701 bp, Homo sapiens
  Payload ID: 17103
  Gene Symbol: SNCG
  Gene Name: synuclein, gamma (breast cancer-specific protein 1)
  Uniprot ID: O76070
  ENST ID: ENST00000372017
  CDS Start-End: 43-426
agctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccactcctgc

SEQ ID NO: 188617 - DNA, 2862 bp, Homo sapiens
  Payload ID: 17104
  Gene Symbol: SYS1
  Gene Name: Sys1 golgi trafficking protein
  Uniprot ID: Q8N2H4
  ENST ID: ENST00000243918
  CDS Start-End: 292-762
ttctgcgcatgtgctcagttcgctatccggctgcttgtacctggttcaggaggttcaggcagaggttgcacccactacgcctgcgcaacctcagccccgcccctccgctgctttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtttgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgttttaagagagaaaaaaaatcaaggatatctgattggagcaaaccacttctttagtcatctgtcttacccccctgggacagctgttacctttgcagtgttgccgaatcacagcagttacctttgcagtgttgccgaatcacagcagttctgttggagaaacgcttggtttccggatccagagccacagaaagaaatgtaggtgtgaagtattaggctgctgtcagggagaggatggcagatggaggcatcaagcacaaggaaaatgcacaacctgtgccctgttatacacacgttcatgtgcacccaagaacctatgactttcttccagttccttctaccaggtccccatcctgctgccagctctcaacatagcaggccataggacccagagaagaatcccagcgttgctcaaagtctaaccatcataaagacactgcctgtcttctaggaatgaccaggcacccagctcccactggactccaattttttttcctgccttatttagaattctttggcgggaagggtatgatgggttcccagagacaagaagcccaaccttctggcctgggctgtgctgatagtgctgagggagataggaatttgctgctaagatttttctttggggtggagtttcctctgtgaggggcttgcagctatccttcctgtgtatacaaatacagtattttccatggttctgcctgcacttactttgtaatgccacggttgagattgagagagatcagcgcagccaggcaagggaactttaaagaattattaggccaccttctccctttcctggaccccagagtcattcctccatttggttaaaatactcagtgcagggaactcttacatcctgtctccttcacttgcagcgtcccctgctatgcctcaggtgaaccacataattcttgggtttccgttcctacttgctagtgatttctgaacatgttcaatggagcggcacacagtctagacccacttccgcattgaaaccttcactgttcctctttggtttcttcagagctttcccaagagagctgtcagttttcagctgtcagtaacacaaatgagtttatggtaacacaaatgagttttgctatctctctgagaagctcatctgacctcctgactctcagccctacagagtagggagttgatgctgacaggatgaagatttaggaataaatatgcctgggaagagactgggaaggttctagggtgaggcacctcagtaactcatggtaccttggccaagttggaaggaagcagtttgttaatgaggcacagtaatcctggctgcagggtctaggaggtaagaccagctgggatgaccttccctgggttaatcaatttccctctagacaacacaaactgcaggcatgtgactaactttgaaagaacacccatcatgtggctgctgtcacccttgaccagccgtggtggtggttactccatctgtggttggagcgcctctttgggattcacttcaaggtcttgtgcctatttttctgcatatcttctgtgatgacaaatctctgtcccctgagtgttaatttgatttttagaaatggccaaaagtcacgtgatccaaactttttttcagtaatatggagactgagctgcatggtagttggggatcaaaaatatgtgaccttaatgagatttttatgatttctaaagtaacaataaaagcagtttttagagttgagttccagagagggcagggcaatggcagtgacatgtttgtcattttaataataaataacatctattgagtgcttaagaggtg

SEQ ID NO: 188618 - DNA, 813 bp, Homo sapiens
  Payload ID: 17104
  Gene Symbol: SYS1
  Gene Name: Sys1 golgi trafficking protein
  Uniprot ID: Q8N2H4
  ENST ID: ENST00000372727
  CDS Start-End: 244-714
ctggaacaacttacttcccgtctttccacttcagagagggggaacctaggatcaatgaagttgatgggttttcgtctgctggagtaggaataaccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaacc

SEQ ID NO: 188619 - DNA, 941 bp, Homo sapiens
  Payload ID: 17104
  Gene Symbol: SYS1
  Gene Name: Sys1 golgi trafficking protein
  ENST ID: ENST00000457307
  CDS Start-End: 90-263
atggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgaggaggcttgctgagatcctggggctctgccaagtcacttctccagtatatttccatttgtgattccccctcagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtgaagtctctgttggtttgggagagatagtgagggcctgtcaaagaaggcaggtagcagtcagcatgacagctgcaagaatgacctctgtctgttgaagccttggtatctgagaggtcaggaaggggacctctttgagggtaataacagaattggaaccatgccactcttgagccacaatacctgtcaccagcctgttgtt

SEQ ID NO: 188620 - DNA, 795 bp, Homo sapiens
  Payload ID: 17104
  Gene Symbol: SYS1
  Gene Name: Sys1 golgi trafficking protein
  ENST ID: ENST00000414310
  CDS Start-End: 278-685
ttcccgtctttccacttcagagagggggaacctaggatcaatgaagttgatgggttttcgtctgctggagtaggaataaccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacctggtggctggtccaagccgtgtgcattgcactcatggctgtcatcggggagtacctgtgcatgcggacggagctcaaggagatacccctcaactcagcccctaaatccaatgtctagaatcaggccctttggacatcctgctgacacttgggccccttaacaccttgggctgctcagaccctccagatgaggtccagcccagatctgagaggaaccctggaaatgtg

SEQ ID NO: 188621 - DNA, 433 bp, Homo sapiens
  Payload ID: 17104
  Gene Symbol: SYS1
  Gene Name: Sys1 golgi trafficking protein
  ENST ID: ENST00000453003
  CDS Start-End: 79-433
agtccctcctcccgggcggggcgacgttgccatggagacaggccgctggctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgtgccctgggcttgctgtacttcatccggcgaggaaagcagtgtctggatttcactgtcactgtccatttctttcacctcctgggctgctggttctacagctcccgtttcccctcggcgctgacct

SEQ ID NO: 188622 - DNA, 2915 bp, Homo sapiens
  Payload ID: 17104
  Gene Symbol: SYS1
  Gene Name: Sys1 golgi trafficking protein
  Uniprot ID: Q8N2H4
  ENST ID: ENST00000426004
  CDS Start-End: 181-411
tttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctgacagggtcttgctctcttgcccaggctggagtgcagtggcgaagtcacagctcactgcagcctcgactcctgggcttaagcgatcctccgacctcagcctcctgagtagctgatactacaagcgcaaggcaccacatctggctaatttttaaattttttgtagagacagtgtctcattatgttgcccaggatggtcttgaactcctggcctcaagcagtcttcctgcctcgacctcccaaggtgctgggattacaggcgtgagccaccatgcctagcctgttcagagtaaatcttatttgaggcatgaatcaatcaaacataaatagagagttgaattgatcttagagggaatgggatgcagcaaagccctacttgaccatctcccccctcccacatttggaaatccttaaacccacttatgtaggcctctgactgtgagattcagagccacagcagtttccacctctgctaaggccttcaggcagtgagatggctcacttcagtgcccctccttccacacatctcctagctgtatcctgagacgcctcaacctagtcactacccttctgtatgatgttggtctaaggcttccccctctctggacatgaaggcggagcctcccagcactaccagccacacaccactcaagactccagatcctgaaccctgactctggggcccagctctgggcctggcttggggcttgcatctcacctagcctggcagtgttgttgtcacacccaccttgtatggatgccacataggcatttcaagtgatgcggagcagaagcgggtgcagcggcgcttgacccaacgcagggtggaggatctgcacatcaccctgggcgccgggaggtggattcgtgtgggcagcccctcaaaccagatccactggtcggctacatccagctgcttcatgtgccccatgggagttctattgcggtagggcttaatgaagatgactcgggggccctcggtgagtggttgcctcccctggactccagggttcaagctatcatccctcgatgtccttggaacctcaggctctatatgcttttctttccgtggcattgccgccaatgacgttttctccttgttcctcatccctgactgcacctgggacttccactccttgtactcttttttcttagggtcccctgtggactctaatttcttggacttgagttccttctcggagcacccgatctcctggaactcttcattattttgttttgttttattgcaggcactgttttccctggcagggagaggaaaggcagtcagcacagcaggaccgaggccctggttcccgagacagttgctatgtagccagctcaggggagcctgttaagaaaggctagaggggcctgcaaagaaacttctctactgcccagaggccttgtgctggtgtgaggaggtgtgatgagcactagcagagggatgtgagagattgggaaggtgaaagccatgactagtagttaaggcccctaagaatgaatattgtctacatcatctgccactagattagggttctgtctctctggacttcagctgggagggtgaacagtccagtagtttttctaaattgtgctccaagaaccttagggttctgaggaggtgtctcaatgtcacctcccctgacccactggggcaggatacctctccccagctcataacaacacaattggggcttggaaatagatatttgaacagaggtttcactgctttaataaagttggaaaactgttcaagaccagcctgggcaacatggtgagactctgtctccatacaaaaaaaaaatttttaagttggaaaatgatggggctagatgatcctgatccttctagctctatgtttcctgattgcctgcgactagaggccaaatcagaaagaggagcccagaaaggtggccttgacagaaatattaaatgctgagactttcccaaagggtgtctgtaacagactgggccccctgcaaacccccagtggcaacaccatcctagccaagggcgtggagagagatgaggccttgggctgcagataatggcaatactgtgatgataataatggctcccgctgattgagtcctcgctctatgccagactcgggacccttacaacttgggatccttactatttctgtgaagtagaaggcagtgaaacagagtggcttacagagcacaggtgttggattcagacaaacgggctcagattctgcttctgcctcttaccacctgtgtgatttgggcaagatatttaacctctcagagccttagcttccttatctgtaaaactaggataattctgtctacctaacaggattgttgtgaagaataaactaaatgggaaaattcttaagtgcttaacactgtaggatggtacttagcaggcaccaatcaatgttagctttcttaatactgtcatgtgacttatgaggaaacggtttgaacttgtctcggaggcatggtaaaaaaaaataaaaataaaaataaattaataaagaaa

SEQ ID NO: 188623 - DNA, 1313 bp, Homo sapiens
  Payload ID: 17105
  Gene Symbol: SYS1-DBNDD2
  Gene Name: SYS1-DBNDD2 readthrough (NMD candidate)
  ENST ID: ENST00000419593
  CDS Start-End: 120-356
gcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 188624 - DNA, 674 bp, Homo sapiens
  Payload ID: 17105
  Gene Symbol: SYS1-DBNDD2
  Gene Name: SYS1-DBNDD2 readthrough (NMD candidate)
  ENST ID: ENST00000452133
  CDS Start-End: 23-259
ccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagat

SEQ ID NO: 188625 - DNA, 673 bp, Homo sapiens
  Payload ID: 17105
  Gene Symbol: SYS1-DBNDD2
  Gene Name: SYS1-DBNDD2 readthrough (NMD candidate)
  ENST ID: ENST00000458187
  CDS Start-End: 31-324
gctgaggcccggctcgtgtccctgcagggcatggcgggtcagttccgcagctacgtgtgggacccgctgctgatcctgtcgcagatcgtcctcatgcagaccgtgtattacggctcgctgggcctgtggctggcgctggtggacgggctagtgcgaagcagcccctcgctggaccagatgttcgacgccgagatcctgggcttttccacccctccaggccggctctccatgatgtccttcatcctcaacgccctcacctggcacttctccttgctgctgccacatgaagaaggacgtgtttgcttccccttccaccatgattgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctagga

SEQ ID NO: 188626 - DNA, 2436 bp, Homo sapiens
  Payload ID: 17106
  Gene Symbol: T
  Gene Name: T brachyury transcription factor
  Uniprot ID: O15178
  ENST ID: ENST00000296946
  CDS Start-End: 470-1777
tttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatgggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaa

SEQ ID NO: 188627 - DNA, 2250 bp, Homo sapiens
  Payload ID: 17106
  Gene Symbol: T
  Gene Name: T brachyury transcription factor
  Uniprot ID: O15178
  ENST ID: ENST00000366871
  CDS Start-End: 458-1591
ggcaacaagtcctgtttttataagagagcgaggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaa

SEQ ID NO: 188628 - DNA, 1497 bp, Homo sapiens
  Payload ID: 17106
  Gene Symbol: T
  Gene Name: T brachyury transcription factor
  ENST ID: ENST00000366876
  CDS Start-End: 287-1497
ggggagggcactgaatttcggtccccagagacctacactagtagagccttggggagttcaagtggaataacttctccccacccctctgcccccgtcccctccccccaagtcttggtccgcgccctcctcccgggtctgtgccgggacccgggacccgggagccgtcgcaggtctcggtccaaggggccccttttctcggaagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcaggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaagg

SEQ ID NO: 188629 - DNA, 902 bp, Homo sapiens
  Payload ID: 17106
  Gene Symbol: T
  Gene Name: T brachyury transcription factor
  ENST ID: ENST00000461348
  CDS Start-End: 174-902
gaggaggacacttctcagaaggggttgttttgcttttgcttatttccgtccatttccctctctgcgcgcggaccttccttttccagatgggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaa

SEQ ID NO: 188630 - DNA, 3687 bp, Homo sapiens
  Payload ID: 17107
  Gene Symbol: TCAIM
  Gene Name: T cell activation inhibitor, mitochondrial
  Uniprot ID: Q8N3R3
  ENST ID: ENST00000342649
  CDS Start-End: 428-1918
ggggaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggatttcgagcagtcaaatttactttgcacaccagagatctgctaagcacagtgttatatattctcaactcctgcagtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatcctggttagataacaatgggaaaagtgctgttaaaaagctaaagaacagtttgccacttagaaaagaactagatcgtttaaaagatgaactgtctcatcaattgcaactctcagatatcaggtggcagaggagctggggcatcgcccaccgctgtagccagctgcatagtttaagccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgctttaaaagtagacttttttaaaaaaattaatttctgctaggagaggttttatatgccaggcgtggtggctcatgcctgcggtcccagctacttagggaggctaagataggaggatcacttgagcccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccacgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaagagatgttaaaataagttcttgaagtatgttttatatttatctaaaacactgattttaaaagtttacattcaaatgtgtattcaaaagaagtactgatttgtaattattatagtttgtgtgtatcatcccttttaaccgtgcctaacaactgtacttaaattttgttttctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccagataa

SEQ ID NO: 188631 - DNA, 1998 bp, Homo sapiens
  Payload ID: 17107
  Gene Symbol: TCAIM
  Gene Name: T cell activation inhibitor, mitochondrial
  Uniprot ID: Q8N3R3
  ENST ID: ENST00000383746
  CDS Start-End: 246-458
ctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccgcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggatgatacatggaagagttttcaatgccctagtgatttttccttatgatgcatgctgctggaccactcccctacaacatcagttaatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttcttgtcattattccctgaacaacacaggataacaactacttacatagcacttacattatattagatattataagtaatctagaaatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaacagaaaaatattcattaactcggggatgcattaataaagtttttaaattcaaaatgtatagaaaaatcaagcttagtaatactttaatattattctaccaatgtattttttttaattaagacttctgtatgcagcagggcatggtggcacacctgtagtcccagctactagggaggctgaggcaggaggattacttgagcccaggaattcaagcctgggcaacatagtgagtcctcatctcctaaatttaaaaaacaaacaacaaaaacttctacgtgtggtaaagggttaactcagcaagcttgggttgcttaaaccttgcacattccaaagaaaggtctgaccccagtgctgacctttgactggctactgggaaatgagctctgagcccctggataggaatgtttctgtttgcctgaggcctttgaccatgccagatagtttatgctaacaatgtgatttatagtgaatacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctccattcttttgttgtaataaaccataatggtgaataaaacagc

SEQ ID NO: 188632 - DNA, 2178 bp, Homo sapiens
  Payload ID: 17107
  Gene Symbol: TCAIM
  Gene Name: T cell activation inhibitor, mitochondrial
  Uniprot ID: Q8N3R3
  ENST ID: ENST00000396078
  CDS Start-End: 428-640
ggggaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggatgatacatggaagagttttcaatgccctagtgatttttccttatgatgcatgctgctggaccactcccctacaacatcagttaatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttcttgtcattattccctgaacaacacaggataacaactacttacatagcacttacattatattagatattataagtaatctagaaatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaacagaaaaatattcattaactcggggatgcattaataaagtttttaaattcaaaatgtatagaaaaatcaagcttagtaatactttaatattattctaccaatgtattttttttaattaagacttctgtatgcagcagggcatggtggcacacctgtagtcccagctactagggaggctgaggcaggaggattacttgagcccaggaattcaagcctgggcaacatagtgagtcctcatctcctaaatttaaaaaacaaacaacaaaaacttctacgtgtggtaaagggttaactcagcaagcttgggttgcttaaaccttgcacattccaaagaaaggtctgaccccagtgctgacctttgactggctactgggaaatgagctctgagcccctggataggaatgtttctgtttgcctgaggcctttgaccatgccagatagtttatgctaacaatgtgatttatagtgaatacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctccattcttttgttgtaataaaccataatggtgaataaaaca

SEQ ID NO: 188633 - DNA, 3449 bp, Homo sapiens
  Payload ID: 17107
  Gene Symbol: TCAIM
  Gene Name: T cell activation inhibitor, mitochondrial
  Uniprot ID: Q8N3R3
  ENST ID: ENST00000431657
  CDS Start-End: 104-451
actgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccgtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatggagtctcgctctgtcacccaagctctggagtgcagtggcgtgatctcagctcactgcaacctccgcctcccgggttcaagcgattcttctgcctcagtctcctaagcagctgggattacagatcctggttagataacaatgggaaaagtgctgttaaaaagctaaagaacagtttgccacttagaaaagaactagatcgtttaaaagatgaactgtctcatcaattgcaactctcagatatcaggtggcagaggagctggggcatcgcccaccgctgtagccagctgcatagtttaagccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacaggtaaatatctaagatagaaggattacttttattccttcgtctaggtgggttgtgtgtgtaaatgcattaaattgttttgtatttcaatgggtagttcttaggaattaaagaaaaaaatgccactacttgtgttagcaaccctcttctacacactagaaaagccagcatgggaggattgaaggatttaatgtctagaacattctttgaatatattgctgagcagatttactgggcaaagtcaatccaatggaaaacattataagattaaactaatagtaaatcagtagccaacatttgtggtgtatacactgtttgccgagcactgtgctgggtacttatatgcattctgtctttagctctcacaacctcactgtgcagcaggtcacccctggcatgtgacagataaggaaggtcagagggcttgcaagtaggtcgtgatcttctgaagaagtgtgtctttgggggcagcaaagctttaagtcaatgttgctgtacttttgaggtggcttttcttgatgatttttttttattttcctgaagactaataaaatattttctctggtgggggagaggagagggtcagtggtttttcctttaatgtatattttattgcagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgctttaaaagtagacttttttaaaaaaattaatttctgctaggagaggttttatatgccaggcgtggtggctcatgcctgcggtcccagctacttagggaggctaagataggaggatcacttgagcccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccacgatcttcctgttattactgatgtttgaaaccctgtcattagccccggcctggttaaagcccctcagagtcacctctcattcatagcaatagaattcaaccccaagtggttgatggtgtccccagcacagccgagagacc

SEQ ID NO: 188634 - DNA, 3306 bp, Homo sapiens
  Payload ID: 17107
  Gene Symbol: TCAIM
  Gene Name: T cell activation inhibitor, mitochondrial
  Uniprot ID: Q8N3R3
  ENST ID: ENST00000412611
  CDS Start-End: 123-470
ctgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccgtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatcctggttagataacaatgggaaaagtgctgttaaaaagctaaagaacagtttgccacttagaaaagaactagatcgtttaaaagatgaactgtctcatcaattgcaactctcagatatcaggtggcagaggagctggggcatcgcccaccgctgtagccagctgcatagtttaagccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgctttaaaagtagacttttttaaaaaaattaatttctgctaggagaggttttatatgccaggcgtggtggctcatgcctgcggtcccagctacttagggaggctaagataggaggatcacttgagcccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccacgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaagagatgttaaaataagttcttgaagtatgttttatatttatctaaaacactgattttaaaagtttacattcaaatgtgtattcaaaagaagtactgatttgtaattattatagtttgtgtgtatcatcccttttaaccgtgcctaacaactgtacttaaattttgttttctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccagataa

SEQ ID NO: 188635 - DNA, 1844 bp, Homo sapiens
  Payload ID: 17107
  Gene Symbol: TCAIM
  Gene Name: T cell activation inhibitor, mitochondrial
  Uniprot ID: Q8N3R3
  ENST ID: ENST00000417237
  CDS Start-End: 246-1736
ctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccgcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggatttcgagcagtcaaatttactttgcacaccagagatctgctaagcacagtgttatatattctcaactcctgcagtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatcctggttagataacaatgggaaaagtgctgttaaaaagctaaagaacagtttgccacttagaaaagaactagatcgtttaaaagatgaactgtctcatcaattgcaactctcagatatcaggtggcagaggagctggggcatcgcccaccgctgtagccagctgcatagtttaagccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttc

SEQ ID NO: 188636 - DNA, 1078 bp, Homo sapiens
  Payload ID: 17107
  Gene Symbol: TCAIM
  Gene Name: T cell activation inhibitor, mitochondrial
  Uniprot ID: Q8N3R3
  ENST ID: ENST00000417768
  CDS Start-End: 74-421
agccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccgtttatctgttgaacatatccaaagcttgaatactaatatgcatacccagcctctcaaagaagctaaaaggatgcctgacaggcccatcaaatgggacaagtcttattactcctttactggattcaaggaccctgatgaagaccttgaacaagtctcgagagtggaaacaactctcacatcctggttagataacaatgggaaaagtgctgttaaaaagctaaagaacagtttgccacttagaaaagaactagatcgtttaaaagatgaactgtctcatcaattgcaactctcagatatcaggtggcagaggagctggggcatcgcccaccgctgtagccagctgcatagtttaagccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcacc

SEQ ID NO: 188637 - DNA, 1056 bp, Homo sapiens
  Payload ID: 17107
  Gene Symbol: TCAIM
  Gene Name: T cell activation inhibitor, mitochondrial
  ENST ID: ENST00000444602
  CDS Start-End: 120-467
tcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggacttcaaatggaaggaggaagagcttgatctgaagaatgctgaagtatgttgaagacaactcctcacccagtctctccagggactagtatttgatagtatatgatctcttaccttttattttctcataattgaatatgggagatcaggagtcacaaattccttttcttggcagtttctccatctacctctgacttagagttttattaaaaatagccctattcttcaatatttaaagatagaaagtcaattcatagcccttttgtgaaggaacaggtatactgaagaatgctgtaaataatgaataataagcatgttgatcactctaagtgacacaattctgtttgaaagtttaaatacatgaatgtgctgttcctaggcatgagagtctcataagcaactgagatagattgttactagtgtaaaaccaaatattcataaatatttttaatagatgtatgctcctgttagtcagggtcaagattaggctaggaattaaataacatcttacatatatgtagtggtctacttaggtttcattatttctccaggaagacagatggaatttttagaggcagattatatcctttatagttgttaaaataaaaatattatcatc

SEQ ID NO: 188638 - DNA, 2967 bp, Homo sapiens
  Payload ID: 17108
  Gene Symbol: TIGIT
  Gene Name: T cell immunoreceptor with Ig and ITIM domains
  Uniprot ID: Q495A1
  ENST ID: ENST00000383671
  CDS Start-End: 77-811
cgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatt

SEQ ID NO: 188639 - DNA, 587 bp, Homo sapiens
  Payload ID: 17108
  Gene Symbol: TIGIT
  Gene Name: T cell immunoreceptor with Ig and ITIM domains
  ENST ID: ENST00000461158
  CDS Start-End: 80-587
gaataggaacagctccggtctacagctcccagcctgagcgacgcagaagacgggtgatttctgcatttccatctgaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagcc

SEQ ID NO: 188640 - DNA, 3149 bp, Homo sapiens
  Payload ID: 17108
  Gene Symbol: TIGIT
  Gene Name: T cell immunoreceptor with Ig and ITIM domains
  Uniprot ID: Q495A1
  ENST ID: ENST00000486257
  CDS Start-End: 258-992
atgttgcccttgattctaggcagagacaggaggcatcagacagctgtgacagccatggagctcccctaccacttctgagccagagggaagactttggagaagcagaagcccaaagacactgctgggagattggtctgtgctctgggagaaccctaggttgtgtttcccgtgtacaagccaccgatcttgtggaagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaaccgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaagacttagactggggttgacaattgttttagcaacaagacaattcaactatttctcctaggatttttattattattattttttcacttttctaccaaatgggttacataggaagaatgaactgaaatctgtccagagctccaagtcctttggaagaaagattagatgaacgtaaaaatgttgttgtttgctgtggcagtttacagcatttttcttgcaaaattagtgcaaatctgttggaaatagaacacaattcacaaattggaagtgaactaaaatgtaatgacgaaaagggagtagtgttttgatttggaggaggtgtatattcggcagaggttggactgagagttgggtgttatttaacataattatggtaattgggaaacatttataaacactattgggatggtgataaaatacaaaagggcctatagatgttagaaatgggtcaggttactgaaatgggattcaatttgaaaaaaatttttttaaatagaactcactgaactagattctcctctgagaaccagagaagaccatttcatagttggattcctggagacatgcgctatccaccacgtagccactttccacatgtggccatcaaccacttaagatggggttagtttaaatcaagatgtgctgttataattggtataagcataaaatcacactagattctggagatttaatatgaataataagaatactatttcagtagttttggtatattgtgtgtcaaaaatgataatattttggatgtattgggtgaaataaaatattaacatta

SEQ ID NO: 188641 - DNA, 559 bp, Homo sapiens
  Payload ID: 17108
  Gene Symbol: TIGIT
  Gene Name: T cell immunoreceptor with Ig and ITIM domains
  ENST ID: ENST00000484319
  CDS Start-End: 70-559
ctacgaaaataacaagctggccatgaagctacatagcagaatatgcgagggggcaacgtgctaagttgaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctg

SEQ ID NO: 188642 - DNA, 3710 bp, Homo sapiens
  Payload ID: 17108
  Gene Symbol: TIGIT
  Gene Name: T cell immunoreceptor with Ig and ITIM domains
  ENST ID: ENST00000481065
  CDS Start-End: 2616-3551
ggagcttggaggagagagcacgaccccctgctgctgccgcaggatgttgcccttgattctaggcagagacaggaggcatcagacagctgtgacagccatggagctcccctaccacttctgagccagagggaagactttggagaagcagaagcccaaagacactgctgggagattggtctgtgctctgggagaaccctaggttgtgtttcccgtgtacaagccaccgatcttgtggaaggtaccaccactcccagccccgcttggctgagggctgcgggccacaggttttcaggaccgtgcttgtggttggaggctgtggactcaagtgcggctggcccgggactttcacagggcgcagggcgggctaggggaaggcccagctgtgaactgataagggggttttacagtctaggccagcacttcttcccctttcacgggcaaacgtgacattctttttcagcacctgtactcacccagctgcatcaaggcggaccagacttgtccaactcacagccccaaaagtcagggcagaataaagcacagtggctgattttagcatttttaaaatagaaatgtgagtcagcacctgatggacctcacagatccctgctatgccacgagggctgctgactggccttaaaagctcagggtggcccggggagctctcagagcaggcctgcttctcacagctgagccgctcagtgctgggggctggtgttgagtgggtgggaaccagccaggttccccgtggagtctgtgcaggaggctctggagggtctggggtagattccctggggagagacttctgtcatttgctttcctccaaggcagcctcagggtctagctggcaagtggtcactttcctgcagaaacatgctatcctcctgttctatcagataaggagggcagaatgaagaggttgggtggaaccctggccttggagtctggagactaggattttactcttgacaaagcacattatatagatagggatattgtcctccaattttcctttcacttccttaattaatattgttatcaatactactgttgatgtattgaactcctgccatcttccaggcactgtgctgaacacttcaccaaacactagagaattaaatcctcacaaccctatgaaagaggtactcttattcctatatgcacatggggaaactgagccttcaggaggttgagaaagttttccaaggtcaccaaacaggatgactttggacccagtctgttaatcatccccctctagagcaccattgatcaaaatggacttgaccatattcctctttggactggttacttagcaaaaaacagaaaaattatttaacaattgtttaaaaccacctctaagtttctctggatatctcattatataagagaggtctcacctctttggctcccacccagctcaactatggaaacacaggctgtaaatttttatagcccaaatcctagtgtccaccactttctgtgctctagtcccactagctgctcttggccctgccactcctggctccccggccttagtgagtttgggaaacatccctccagttcaaccttggcaccttcccttggacacacattaggtattatttctccttcagctgaaggctttgtagctattgaaaggcaaggcatctcttgatgtgagccttgaaggacaggttgctttgggtaggcagagagaagctggtaaggcgtatattgtctaagggtctggaggtggggtataaggggtatacaagtcatagagttggggataggcagaacccagagaggggagaaaactggcctgagatagaagaccttgcaagggagaaggagggtaggagcctggatggtgtgaaatgctagaggtgcatggctggaatggagggggtggggcaccaggcttcagatgcttctgggtgcagatgcagattttcaggatgtacaacatggagcatccccaaggcaactgtgttgagagcctgcgaggcaggtgaatgtggatcttctaccccctctcctgactgagttcaccaaggaacaagctttgtaaactatttgaggctcccaggggctcacccttctttgcatttccagctctcatgaggtcattgtgcacaggaaagctctctcctctaatctcctctgatcctactgcaccagagaaatcaagccagaattcaataaagtctcagtccagataaacaagacaaaagaaataagattcgagtagaagatctccttcaagggaaagttgctgtgtttgtccaagacctttgtcccatccatgtatcatcccccaagtaaacacttcttgttcacctgttcattagatttcaagtgcagtccctggcctgtaagtccctacaatgataagcttctcttatcattgcacattcttcatcaggaggatgccagaggagctcagccaacagttcctcatcagtagcagattcttcagaatcttgggcactacacagatgcccttgagctctttgaataaaggctgatttttagaaaaaacattaagacagaacttaaaaacaatagattgactataatccaaagacgagtgtacctctaaccacaattttcatttatttttaaatgtttccttcatggcctttcttgtggctcaccctatgcagtttgtgtatttgttgacaactttatgtgtttttaatatggtttttgccaaacttggtttttccgagaccgtcttttctcagaggctcagttttaccgtcctatctgcagtcggctactttcagtggcagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggcctcaccctccagtcgctgaccgtgaacgatacaggggagtacttctgcatctatcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttca

SEQ ID NO: 188643 - DNA, 976 bp, Homo sapiens
  Payload ID: 17109
  Gene Symbol: TRAC
  Gene Name: T cell receptor alpha constant
  ENST ID: ENST00000611116
  CDS Start-End: 1-425
atatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttcattaaaatgatttggaagagca

SEQ ID NO: 188644 - DNA, 1147 bp, Homo sapiens
  Payload ID: 17109
  Gene Symbol: TRAC
  Gene Name: T cell receptor alpha constant
  ENST ID: ENST00000616778
  CDS Start-End: 109-597
ctgggactgaggtgttctaagcctggaaagacacaaagctgtcctcatcccaacctgccgtgcccctccttgagggttagtgtaaggctctgaaggactgtgtgaattatggtggtgctacaaacaagctcatctttggaactggcactctgcttgctgtccagccaagtacatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctgcagaatgttgtgaggggtttatttttttttaatagtgttcataaagaaatacatagtattcttcttctcaagacgtggggggaaattatctcattatcgaggccctgctatgctgtgtatctgggcgtgttgtatgtcctgctgccgatgccttcattaaaatgatttggaagagc

SEQ ID NO: 188645 - DNA, 62 bp, Homo sapiens
  Payload ID: 17110
  Gene Symbol: TRAJ1
  Gene Name: T cell receptor alpha joining 1 (non-functional)
  ENST ID: ENST00000390536
  CDS Start-End: 1-62
gtatgaaagtattacctcccagttgcaatttggcaaaggaaccagagtttccacttctcccc

SEQ ID NO: 188646 - DNA, 64 bp, Homo sapiens
  Payload ID: 17111
  Gene Symbol: TRAJ10
  Gene Name: T cell receptor alpha joining 10
  ENST ID: ENST00000390527
  CDS Start-End: 1-64
atactcacgggaggaggaaacaaactcacctttgggacaggcactcagctaaaagtggaactca

SEQ ID NO: 188647 - DNA, 60 bp, Homo sapiens
  Payload ID: 17112
  Gene Symbol: TRAJ11
  Gene Name: T cell receptor alpha joining 11
  ENST ID: ENST00000390526
  CDS Start-End: 1-60
tgaattcaggatacagcaccctcacctttgggaaggggactatgcttctagtctctccag

SEQ ID NO: 188648 - DNA, 60 bp, Homo sapiens
  Payload ID: 17113
  Gene Symbol: TRAJ12
  Gene Name: T cell receptor alpha joining 12
  ENST ID: ENST00000390525
  CDS Start-End: 1-60
ggatggatagcagctataaattgatcttcgggagtgggaccagactgctggtcaggcctg

SEQ ID NO: 188649 - DNA, 63 bp, Homo sapiens
  Payload ID: 17114
  Gene Symbol: TRAJ13
  Gene Name: T cell receptor alpha joining 13
  ENST ID: ENST00000390524
  CDS Start-End: 1-63
tgaattctgggggttaccagaaagttacctttggaactggaacaaagctccaagtcatcccaa

SEQ ID NO: 188650 - DNA, 52 bp, Homo sapiens
  Payload ID: 17115
  Gene Symbol: TRAJ14
  Gene Name: T cell receptor alpha joining 14
  ENST ID: ENST00000390523
  CDS Start-End: 1-52
atttatagcacattcatctttgggagtgggacaagattatcagtaaaacctg

SEQ ID NO: 188651 - DNA, 60 bp, Homo sapiens
  Payload ID: 17116
  Gene Symbol: TRAJ16
  Gene Name: T cell receptor alpha joining 16
  ENST ID: ENST00000390521
  CDS Start-End: 1-60
ggttttcagatggccagaagctgctctttgcaagggggaccatgttaaaggtggatctta

SEQ ID NO: 188652 - DNA, 63 bp, Homo sapiens
  Payload ID: 17117
  Gene Symbol: TRAJ17
  Gene Name: T cell receptor alpha joining 17
  ENST ID: ENST00000390520
  CDS Start-End: 1-63
tgatcaaagctgcaggcaacaagctaacttttggaggaggaaccagggtgctagttaaaccaa

SEQ ID NO: 188653 - DNA, 66 bp, Homo sapiens
  Payload ID: 17118
  Gene Symbol: TRAJ18
  Gene Name: T cell receptor alpha joining 18
  ENST ID: ENST00000390519
  CDS Start-End: 1-66
ccgacagaggctcaaccctggggaggctatactttggaagaggaactcagttgactgtctggcctg

SEQ ID NO: 188654 - DNA, 60 bp, Homo sapiens
  Payload ID: 17119
  Gene Symbol: TRAJ19
  Gene Name: T cell receptor alpha joining 19 (non-functional)
  ENST ID: ENST00000390518
  CDS Start-End: 1-60
gctatcaaagattttacaatttcacctttggaaagggatccaaacataatgtcactccaa

SEQ ID NO: 188655 - DNA, 66 bp, Homo sapiens
  Payload ID: 17120
  Gene Symbol: TRAJ2
  Gene Name: T cell receptor alpha joining 2 (non-functional)
  ENST ID: ENST00000390535
  CDS Start-End: 1-66
tgaatactggaggaacaattgataaactcacatttgggaaagggacccatgtattcattatatctg

SEQ ID NO: 188656 - DNA, 57 bp, Homo sapiens
  Payload ID: 17121
  Gene Symbol: TRAJ20
  Gene Name: T cell receptor alpha joining 20
  ENST ID: ENST00000390517
  CDS Start-End: 1-57
gttctaacgactacaagctcagctttggagccggaaccacagtaactgtaagagcaa

SEQ ID NO: 188657 - DNA, 55 bp, Homo sapiens
  Payload ID: 17122
  Gene Symbol: TRAJ21
  Gene Name: T cell receptor alpha joining 21
  ENST ID: ENST00000390516
  CDS Start-End: 1-55
tacaacttcaacaaattttactttggatctgggaccaaactcaatgtaaaaccaa

SEQ ID NO: 188658 - DNA, 63 bp, Homo sapiens
  Payload ID: 17123
  Gene Symbol: TRAJ22
  Gene Name: T cell receptor alpha joining 22
  ENST ID: ENST00000390515
  CDS Start-End: 1-63
tttcttctggttctgcaaggcaactgacctttggatctgggacacaattgactgttttacctg

SEQ ID NO: 188659 - DNA, 63 bp, Homo sapiens
  Payload ID: 17124
  Gene Symbol: TRAJ23
  Gene Name: T cell receptor alpha joining 23
  ENST ID: ENST00000390514
  CDS Start-End: 1-63
tgatttataaccagggaggaaagcttatcttcggacagggaacggagttatctgtgaaaccca

SEQ ID NO: 188660 - DNA, 63 bp, Homo sapiens
  Payload ID: 17125
  Gene Symbol: TRAJ24
  Gene Name: T cell receptor alpha joining 24
  ENST ID: ENST00000390513
  CDS Start-End: 1-63
tgacaactgacagctgggggaaattccagtttggagcagggacccaggttgtggtcaccccag

SEQ ID NO: 188661 - DNA, 60 bp, Homo sapiens
  Payload ID: 17126
  Gene Symbol: TRAJ25
  Gene Name: T cell receptor alpha joining 25 (non-functional)
  ENST ID: ENST00000390512
  CDS Start-End: 1-60
cagaaggacaaggcttctcctttatctttgggaaggggacaaggctgcttgtcaagccaa

SEQ ID NO: 188662 - DNA, 60 bp, Homo sapiens
  Payload ID: 17127
  Gene Symbol: TRAJ26
  Gene Name: T cell receptor alpha joining 26
  ENST ID: ENST00000390511
  CDS Start-End: 1-60
gggataactatggtcagaattttgtctttggtcccggaaccagattgtccgtgctgccct

SEQ ID NO: 188663 - DNA, 59 bp, Homo sapiens
  Payload ID: 17128
  Gene Symbol: TRAJ27
  Gene Name: T cell receptor alpha joining 27
  ENST ID: ENST00000390510
  CDS Start-End: 1-59
taacaccaatgcaggcaaatcaacctttggggatgggactacgctcactgtgaagccaa

SEQ ID NO: 188664 - DNA, 66 bp, Homo sapiens
  Payload ID: 17129
  Gene Symbol: TRAJ28
  Gene Name: T cell receptor alpha joining 28
  ENST ID: ENST00000390509
  CDS Start-End: 1-66
catactctggggctgggagttaccaactcactttcgggaaggggaccaaactctcggtcataccaa

SEQ ID NO: 188665 - DNA, 60 bp, Homo sapiens
  Payload ID: 17130
  Gene Symbol: TRAJ29
  Gene Name: T cell receptor alpha joining 29
  ENST ID: ENST00000390508
  CDS Start-End: 1-60
ggaattcaggaaacacacctcttgtctttggaaagggcacaagactttctgtgattgcaa

SEQ ID NO: 188666 - DNA, 62 bp, Homo sapiens
  Payload ID: 17131
  Gene Symbol: TRAJ3
  Gene Name: T cell receptor alpha joining 3
  ENST ID: ENST00000390534
  CDS Start-End: 1-62
ggggtacagcagtgcttccaagataatctttggatcagggaccagactcagcatccggccaa

SEQ ID NO: 188667 - DNA, 57 bp, Homo sapiens
  Payload ID: 17132
  Gene Symbol: TRAJ30
  Gene Name: T cell receptor alpha joining 30
  ENST ID: ENST00000390507
  CDS Start-End: 1-57
tgaacagagatgacaagatcatctttggaaaagggacacgacttcatattctcccca

SEQ ID NO: 188668 - DNA, 57 bp, Homo sapiens
  Payload ID: 17133
  Gene Symbol: TRAJ31
  Gene Name: T cell receptor alpha joining 31
  ENST ID: ENST00000390506
  CDS Start-End: 1-57
ggaataacaatgccagactcatgtttggagatggaactcagctggtggtgaagccca

SEQ ID NO: 188669 - DNA, 66 bp, Homo sapiens
  Payload ID: 17134
  Gene Symbol: TRAJ32
  Gene Name: T cell receptor alpha joining 32
  ENST ID: ENST00000390505
  CDS Start-End: 1-66
tgaattatggtggtgctacaaacaagctcatctttggaactggcactctgcttgctgtccagccaa

SEQ ID NO: 188670 - DNA, 57 bp, Homo sapiens
  Payload ID: 17135
  Gene Symbol: TRAJ33
  Gene Name: T cell receptor alpha joining 33
  ENST ID: ENST00000390504
  CDS Start-End: 1-57
tggatagcaactatcagttaatctggggcgctgggaccaagctaattataaagccag

SEQ ID NO: 188671 - DNA, 58 bp, Homo sapiens
  Payload ID: 17136
  Gene Symbol: TRAJ34
  Gene Name: T cell receptor alpha joining 34
  ENST ID: ENST00000390503
  CDS Start-End: 1-58
tcttataacaccgacaagctcatctttgggactgggaccagattacaagtctttccaa

SEQ ID NO: 188672 - DNA, 59 bp, Homo sapiens
  Payload ID: 17137
  Gene Symbol: TRAJ35
  Gene Name: T cell receptor alpha joining 35 (non-functional)
  ENST ID: ENST00000390502
  CDS Start-End: 1-59
gataggctttgggaatgtgctgcattgcgggtccggcactcaagtgattgttttaccac

SEQ ID NO: 188673 - DNA, 58 bp, Homo sapiens
  Payload ID: 17138
  Gene Symbol: TRAJ36
  Gene Name: T cell receptor alpha joining 36
  ENST ID: ENST00000614481
  CDS Start-End: 1-58
tcaaactggggcaaacaacctcttctttgggactggaacgagactcaccgttattccc

SEQ ID NO: 188674 - DNA, 65 bp, Homo sapiens
  Payload ID: 17139
  Gene Symbol: TRAJ37
  Gene Name: T cell receptor alpha joining 37
  ENST ID: ENST00000612375
  CDS Start-End: 1-65
tggctctagcaacacaggcaaactaatctttgggcaagggacaactttacaagtaaaaccaggta

SEQ ID NO: 188675 - DNA, 62 bp, Homo sapiens
  Payload ID: 17140
  Gene Symbol: TRAJ38
  Gene Name: T cell receptor alpha joining 38
  ENST ID: ENST00000390499
  CDS Start-End: 1-62
taatgctggcaacaaccgtaagctgatttggggattgggaacaagcctggcagtaaatccga

SEQ ID NO: 188676 - DNA, 63 bp, Homo sapiens
  Payload ID: 17141
  Gene Symbol: TRAJ39
  Gene Name: T cell receptor alpha joining 39
  ENST ID: ENST00000390498
  CDS Start-End: 1-63
tgaataataatgcaggcaacatgctcacctttggagggggaacaaggttaatggtcaaacccc

SEQ ID NO: 188677 - DNA, 63 bp, Homo sapiens
  Payload ID: 17142
  Gene Symbol: TRAJ4
  Gene Name: T cell receptor alpha joining 4
  ENST ID: ENST00000390533
  CDS Start-End: 1-63
tgttttctggtggctacaataagctgatttttggagcagggaccaggctggctgtacacccat

SEQ ID NO: 188678 - DNA, 61 bp, Homo sapiens
  Payload ID: 17143
  Gene Symbol: TRAJ40
  Gene Name: T cell receptor alpha joining 40
  ENST ID: ENST00000390497
  CDS Start-End: 1-61
actacctcaggaacctacaaatacatctttggaacaggcaccaggctgaaggttttagcaa

SEQ ID NO: 188679 - DNA, 62 bp, Homo sapiens
  Payload ID: 17144
  Gene Symbol: TRAJ41
  Gene Name: T cell receptor alpha joining 41
  ENST ID: ENST00000390496
  CDS Start-End: 1-62
gaactcaaattccgggtatgcactcaacttcggcaaaggcacctcgctgttggtcacacccc

SEQ ID NO: 188680 - DNA, 66 bp, Homo sapiens
  Payload ID: 17145
  Gene Symbol: TRAJ42
  Gene Name: T cell receptor alpha joining 42
  ENST ID: ENST00000390495
  CDS Start-End: 1-66
tgaattatggaggaagccaaggaaatctcatctttggaaaaggcactaaactctctgttaaaccaa

SEQ ID NO: 188681 - DNA, 54 bp, Homo sapiens
  Payload ID: 17146
  Gene Symbol: TRAJ43
  Gene Name: T cell receptor alpha joining 43
  ENST ID: ENST00000390494
  CDS Start-End: 1-54
acaataacaatgacatgcgctttggagcagggaccagactgacagtaaaaccaa

SEQ ID NO: 188682 - DNA, 63 bp, Homo sapiens
  Payload ID: 17147
  Gene Symbol: TRAJ44
  Gene Name: T cell receptor alpha joining 44
  ENST ID: ENST00000390493
  CDS Start-End: 1-63
taaataccggcactgccagtaaactcacctttgggactggaacaagacttcaggtcacgctcg

SEQ ID NO: 188683 - DNA, 66 bp, Homo sapiens
  Payload ID: 17148
  Gene Symbol: TRAJ45
  Gene Name: T cell receptor alpha joining 45
  ENST ID: ENST00000390492
  CDS Start-End: 1-66
tgtattcaggaggaggtgctgacggactcacctttggcaaagggactcatctaatcatccagccct

SEQ ID NO: 188684 - DNA, 63 bp, Homo sapiens
  Payload ID: 17149
  Gene Symbol: TRAJ46
  Gene Name: T cell receptor alpha joining 46
  ENST ID: ENST00000390491
  CDS Start-End: 1-63
agaagaaaagcagcggagacaagctgacttttgggaccgggactcgtttagcagttaggccca

SEQ ID NO: 188685 - DNA, 57 bp, Homo sapiens
  Payload ID: 17150
  Gene Symbol: TRAJ47
  Gene Name: T cell receptor alpha joining 47
  ENST ID: ENST00000390490
  CDS Start-End: 1-57
tggaatatggaaacaaactggtctttggcgcaggaaccattctgagagtcaagtcct

SEQ ID NO: 188686 - DNA, 63 bp, Homo sapiens
  Payload ID: 17151
  Gene Symbol: TRAJ48
  Gene Name: T cell receptor alpha joining 48
  ENST ID: ENST00000390489
  CDS Start-End: 1-63
tatctaactttggaaatgagaaattaacctttgggactggaacaagactcaccatcataccca

SEQ ID NO: 188687 - DNA, 56 bp, Homo sapiens
  Payload ID: 17152
  Gene Symbol: TRAJ49
  Gene Name: T cell receptor alpha joining 49
  ENST ID: ENST00000390488
  CDS Start-End: 1-56
gaacaccggtaaccagttctattttgggacagggacaagtttgacggtcattccaa

SEQ ID NO: 188688 - DNA, 60 bp, Homo sapiens
  Payload ID: 17153
  Gene Symbol: TRAJ5
  Gene Name: T cell receptor alpha joining 5
  ENST ID: ENST00000390532
  CDS Start-End: 1-60
tggacacgggcaggagagcacttacttttgggagtggaacaagactccaagtgcaaccaa

SEQ ID NO: 188689 - DNA, 60 bp, Homo sapiens
  Payload ID: 17154
  Gene Symbol: TRAJ50
  Gene Name: T cell receptor alpha joining 50
  ENST ID: ENST00000390487
  CDS Start-End: 1-60
tgaaaacctcctacgacaaggtgatatttgggccagggacaagcttatcagtcattccaa

SEQ ID NO: 188690 - DNA, 69 bp, Homo sapiens
  Payload ID: 17155
  Gene Symbol: TRAJ52
  Gene Name: T cell receptor alpha joining 52
  ENST ID: ENST00000390486
  CDS Start-End: 1-69
ctaatgctggtggtactagctatggaaagctgacatttggacaagggaccatcttgactgtccatccaa

SEQ ID NO: 188691 - DNA, 66 bp, Homo sapiens
  Payload ID: 17156
  Gene Symbol: TRAJ53
  Gene Name: T cell receptor alpha joining 53
  ENST ID: ENST00000390485
  CDS Start-End: 1-66
agaatagtggaggtagcaactataaactgacatttggaaaaggaactctcttaaccgtgaatccaa

SEQ ID NO: 188692 - DNA, 60 bp, Homo sapiens
  Payload ID: 17157
  Gene Symbol: TRAJ54
  Gene Name: T cell receptor alpha joining 54
  ENST ID: ENST00000390484
  CDS Start-End: 1-60
taattcagggagcccagaagctggtatttggccaaggaaccaggctgactatcaacccaa

SEQ ID NO: 188693 - DNA, 62 bp, Homo sapiens
  Payload ID: 17158
  Gene Symbol: TRAJ56
  Gene Name: T cell receptor alpha joining 56
  ENST ID: ENST00000390483
  CDS Start-End: 1-62
ttatactggagccaatagtaagctgacatttggaaaaggaataactctgagtgttagaccag

SEQ ID NO: 188694 - DNA, 63 bp, Homo sapiens
  Payload ID: 17159
  Gene Symbol: TRAJ57
  Gene Name: T cell receptor alpha joining 57
  ENST ID: ENST00000390482
  CDS Start-End: 1-63
taactcagggcggatctgaaaagctggtctttggaaagggaacgaaactgacagtaaacccat

SEQ ID NO: 188695 - DNA, 63 bp, Homo sapiens
  Payload ID: 17160
  Gene Symbol: TRAJ58
  Gene Name: T cell receptor alpha joining 58 (non-functional)
  ENST ID: ENST00000390481
  CDS Start-End: 1-63
tttaagaaaccagtggctctaggttgacctttggggaaggaacacagctcacagtgaatcctg

SEQ ID NO: 188696 - DNA, 54 bp, Homo sapiens
  Payload ID: 17161
  Gene Symbol: TRAJ59
  Gene Name: T cell receptor alpha joining 59 (non-functional)
  ENST ID: ENST00000390480
  CDS Start-End: 1-54
ggaaggaaggaaacaggaaatttacatttggaatggggacgcaagtgagagtga

SEQ ID NO: 188697 - DNA, 62 bp, Homo sapiens
  Payload ID: 17162
  Gene Symbol: TRAJ6
  Gene Name: T cell receptor alpha joining 6
  ENST ID: ENST00000390531
  CDS Start-End: 1-62
tgcatcaggaggaagctacatacctacatttggaagaggaaccagccttattgttcatccgt

SEQ ID NO: 188698 - DNA, 60 bp, Homo sapiens
  Payload ID: 17163
  Gene Symbol: TRAJ61
  Gene Name: T cell receptor alpha joining 61 (non-functional)
  ENST ID: ENST00000390479
  CDS Start-End: 1-60
ggtaccgggttaataggaaactgacatttggagccaacactagaggaatcatgaaactca

SEQ ID NO: 188699 - DNA, 59 bp, Homo sapiens
  Payload ID: 17164
  Gene Symbol: TRAJ7
  Gene Name: T cell receptor alpha joining 7
  ENST ID: ENST00000390530
  CDS Start-End: 1-59
tgactatgggaacaacagactcgcttttgggaaggggaaccaagtggtggtcataccaa

SEQ ID NO: 188700 - DNA, 61 bp, Homo sapiens
  Payload ID: 17165
  Gene Symbol: TRAJ9
  Gene Name: T cell receptor alpha joining 9
  ENST ID: ENST00000390528
  CDS Start-End: 1-61
ggaaatactggaggcttcaaaactatctttggagcaggaacaagactatttgttaaagcaa

SEQ ID NO: 188701 - DNA, 379 bp, Homo sapiens
  Payload ID: 17166
  Gene Symbol: TRAV10
  Gene Name: T cell receptor alpha variable 10
  ENST ID: ENST00000390432
  CDS Start-End: 37-379
agtcaacttctgggagcagatctctgcagaataaaaatgaaaaagcatctgacgaccttcttggtgattttgtggctttatttttatagggggaatggcaaaaaccaagtggagcagagtcctcagtccctgatcatcctggagggaaagaactgcactcttcaatgcaattatacagtgagccccttcagcaacttaaggtggtataagcaagatacggggagaggtcctgtttccctgacaatcatgactttcagtgagaacacaaagtcgaacggaagatatacagcaactctggatgcagacacaaagcaaagctctctgcacatcacagcctcccagctcagcgattcagcctcctacatctgtgtggtgagcg

SEQ ID NO: 188702 - DNA, 392 bp, Homo sapiens
  Payload ID: 17167
  Gene Symbol: TRAV1-1
  Gene Name: T cell receptor alpha variable 1-1
  ENST ID: ENST00000542354
  CDS Start-End: 67-392
cttctgcagactacagtggctcaggaaccggggatgcagtgccaggctcatggtatcctgcagcagatgtggggagctttccttctctatgtttccatgaagatgggaggcactgcaggacaaagccttgagcagccctctgaagtgacagctgtggaaggagccattgtccagataaactgcacgtaccagacatctgggttttatgggctgtcctggtaccagcaacatgatggcggagcacccacatttctttcttacaatgctctggatggtttggaggagacaggtcgtttttcttcattccttagtcgctctgatagttatggttacctccttctacaggagctccagatgaaagactctgcctcttacttctgcgctgtgagaga

SEQ ID NO: 188703 - DNA, 402 bp, Homo sapiens
  Payload ID: 17168
  Gene Symbol: TRAV1-2
  Gene Name: T cell receptor alpha variable 1-2
  ENST ID: ENST00000390423
  CDS Start-End: 85-402
cccacatgaagtgtctaccttctgcagactccaatggctcaggaactgggaatgcagtgccaggctcgtggtatcctgcagcagatgtggggagttttccttctttatgtttccatgaagatgggaggcactacaggacaaaacattgaccagcccactgagatgacagctacggaaggtgccattgtccagatcaactgcacgtaccagacatctgggttcaacgggctgttctggtaccagcaacatgctggcgaagcacctacatttctgtcttacaatgttctggatggtttggaggagaaaggtcgtttttcttcattccttagtcggtctaaagggtacagttacctccttttgaaggagctccagatgaaagactctgcctcttacctctgtgct

SEQ ID NO: 188704 - DNA, 340 bp, Homo sapiens
  Payload ID: 17169
  Gene Symbol: TRAV12-1
  Gene Name: T cell receptor alpha variable 12-1
  ENST ID: ENST00000390433
  CDS Start-End: 4-340
atgatgatatccttgagagttttactggtgatcctgtggcttcagttaagctgggtttggagccaacggaaggaggtggagcaggatcctggacccttcaatgttccagagggagccactgtcgctttcaactgtacttacagcaacagtgcttctcagtctttcttctggtacagacaggattgcaggaaagaacctaagttgctgatgtccgtatactccagtggtaatgaagatggaaggtttacagcacagctcaatagagccagccagtatatttccctgctcatcagagactccaagctcagtgattcagccacctacctctgtgtggtgaaca

SEQ ID NO: 188705 - DNA, 445 bp, Homo sapiens
  Payload ID: 17170
  Gene Symbol: TRAV12-2
  Gene Name: T cell receptor alpha variable 12-2
  ENST ID: ENST00000390437
  CDS Start-End: 106-445
aaagcagattctttttatgatttttaaagtagaaatatccattctaggtgcattttttaagggtttaaaatttgaatcctcagtgaaccagggcagagaagaatgatgaaatccttgagagttttactagtgatcctgtggcttcagttgagctgggtttggagccaacagaaggaggtggagcagaattctggacccctcagtgttccagagggagccattgcctctctcaactgcacttacagtgaccgaggttcccagtccttcttctggtacagacaatattctgggaaaagccctgagttgataatgttcatatactccaatggtgacaaagaagatggaaggtttacagcacagctcaataaagccagccagtatgtttctctgctcatcagagactcccagcccagtgattcagccacctacctctgtgccgtgaaca

SEQ ID NO: 188706 - DNA, 399 bp, Homo sapiens
  Payload ID: 17171
  Gene Symbol: TRAV12-3
  Gene Name: T cell receptor alpha variable 12-3
  ENST ID: ENST00000390442
  CDS Start-End: 57-399
attatttttttttcgtgtttaaggtttgaatcctcagtgaaccagggcagaaaagaatgatgaaatccttgagagttttactggtgatcctgtggcttcagttaagctgggtttggagccaacagaaggaggtggagcaggatcctggaccactcagtgttccagagggagccattgtttctctcaactgcacttacagcaacagtgcttttcaatacttcatgtggtacagacagtattccagaaaaggccctgagttgctgatgtacacatactccagtggtaacaaagaagatggaaggtttacagcacaggtcgataaatccagcaagtatatctccttgttcatcagagactcacagcccagtgattcagccacctacctctgtgcaatgagcg

SEQ ID NO: 188707 - DNA, 360 bp, Homo sapiens
  Payload ID: 17172
  Gene Symbol: TRAV13-1
  Gene Name: T cell receptor alpha variable 13-1
  ENST ID: ENST00000390436
  CDS Start-End: 24-360
gatcttaattgggaagaacaaggatgacatccattcgagctgtatttatattcctgtggctgcagctggacttggtgaatggagagaatgtggagcagcatccttcaaccctgagtgtccaggagggagacagcgctgttatcaagtgtacttattcagacagtgcctcaaactacttcccttggtataagcaagaacttggaaaaggacctcagcttattatagacattcgttcaaatgtgggcgaaaagaaagaccaacgaattgctgttacattgaacaagacagccaaacatttctccctgcacatcacagagacccaacctgaagactcggctgtctacttctgtgcagcaagta

SEQ ID NO: 188708 - DNA, 410 bp, Homo sapiens
  Payload ID: 17173
  Gene Symbol: TRAV13-2
  Gene Name: T cell receptor alpha variable 13-2
  ENST ID: ENST00000390439
  CDS Start-End: 71-410
cgatgatggaagtagctcttatggctggagattgcaggtttatgactgatcctatttgggaagaacaatgatggcaggcattcgagctttatttatgtacttgtggctgcagctggactgggtgagcagaggagagagtgtggggctgcatcttcctaccctgagtgtccaggagggtgacaactctattatcaactgtgcttattcaaacagcgcctcagactacttcatttggtacaagcaagaatctggaaaaggtcctcaattcattatagacattcgttcaaatatggacaaaaggcaaggccaaagagtcaccgttttattgaataagacagtgaaacatctctctctgcaaattgcagctactcaacctggagactcagctgtctacttttgtgcagagaata

SEQ ID NO: 188709 - DNA, 425 bp, Homo sapiens
  Payload ID: 17174
  Gene Symbol: TRAV14DV4
  Gene Name: T cell receptor alpha variable 14/delta variable 4
  ENST ID: ENST00000390440
  CDS Start-End: 76-425
gccaggttcacttcacagtacagagtcctgaaaataaagaagaaaatttttttttatctagaaaaagaaccaaacatgtcactttctagcctgctgaaggtggtcacagcttcactgtggctaggacctggcattgcccagaagataactcaaacccaaccaggaatgttcgtgcaggaaaaggaggctgtgactctggactgcacatatgacaccagtgatccaagttatggtctattctggtacaagcagcccagcagtggggaaatgatttttcttatttatcaggggtcttatgaccagcaaaatgcaacagaaggtcgctactcattgaatttccagaaggcaagaaaatccgccaaccttgtcatctccgcttcacaactgggggactcagcaatgtacttctgtgcaatgagagaggg

SEQ ID NO: 188710 - DNA, 329 bp, Homo sapiens
  Payload ID: 17175
  Gene Symbol: TRAV16
  Gene Name: T cell receptor alpha variable 16
  ENST ID: ENST00000390444
  CDS Start-End: 1-329
atgaagcccaccctcatctcagtgcttgtgataatatttatactcagaggaacaagagcccagagagtgactcagcccgagaagctcctctctgtctttaaaggggccccagtggagctgaagtgcaactattcctattctgggagtcctgaactcttctggtatgtccagtactccagacaacgcctccagttactcttgagacacatctctagagagagcatcaaaggcttcactgctgaccttaacaaaggcgagacatctttccacctgaagaaaccatttgctcaagaggaagactcagccatgtattactgtgctctaagtgg

SEQ ID NO: 188711 - DNA, 484 bp, Homo sapiens
  Payload ID: 17176
  Gene Symbol: TRAV17
  Gene Name: T cell receptor alpha variable 17
  ENST ID: ENST00000390445
  CDS Start-End: 148-484
aggactgagcttgcctgtgactggctagggaggaacctgagactaggggacagaaagactagggattcacccagtaaagagagctcatctgtgactgaggagccttgctccatttcaggtcttctgtgatttcaataaggaagaagaatggaaactctcctgggagtgtctttggtgattctatggcttcaactggctagggtgaacagtcaacagggagaagaggatcctcaggccttgagcatccaggagggtgaaaatgccaccatgaactgcagttacaaaactagtataaacaatttacagtggtatagacaaaattcaggtagaggccttgtccacctaattttaatacgttcaaatgaaagagagaaacacagtggaagattaagagtcacgcttgacacttccaagaaaagcagttccttgttgatcacggcttcccgggcagcagacactgcttcttacttctgtgctacggacg

SEQ ID NO: 188712 - DNA, 440 bp, Homo sapiens
  Payload ID: 17177
  Gene Symbol: TRAV18
  Gene Name: T cell receptor alpha variable 18
  ENST ID: ENST00000390446
  CDS Start-End: 106-440
gattttgtagaagattccgccaaagactcaacaacataaagaaatatatatacctttcggtttggatatctctcaacaaaaccttctactgcttctcagccagccatgctgtctgcttcctgctcaggacttgtgatcttgttgatattcagaaggaccagtggagactcggttacccagacagaaggcccagttaccctccctgagagggcagctctgacattaaactgcacttatcagtccagctattcaacttttctattctggtatgtccagtatctaaacaaagagcctgagctcctcctgaaaagttcagaaaaccaggagacggacagcagaggttttcaggccagtcctatcaagagtgacagttccttccacctggagaagccctcggtgcagctgtcggactctgccgtgtactactgcgctctgagaga

SEQ ID NO: 188713 - DNA, 467 bp, Homo sapiens
  Payload ID: 17178
  Gene Symbol: TRAV19
  Gene Name: T cell receptor alpha variable 19
  ENST ID: ENST00000390447
  CDS Start-End: 118-467
cagaagcctcacacagcccagtaactttgctagtacctcttgagtgcaaggtggagaattaagatctggatttgagacggagcacggaacatttcactcaggggaagagctatgaacatgctgactgccagcctgttgagggcagtcatagcctccatctgtgttgtatccagcatggctcagaaggtaactcaagcgcagactgaaatttctgtggtggagaaggaggatgtgaccttggactgtgtgtatgaaacccgtgatactacttattacttattctggtacaagcaaccaccaagtggagaattggttttccttattcgtcggaactcttttgatgagcaaaatgaaataagtggtcggtattcttggaacttccagaaatccaccagttccttcaacttcaccatcacagcctcacaagtcgtggactcagcagtatacttctgtgctctgagtgaggc

SEQ ID NO: 188714 - DNA, 348 bp, Homo sapiens
  Payload ID: 17179
  Gene Symbol: TRAV2
  Gene Name: T cell receptor alpha variable 2
  ENST ID: ENST00000390424
  CDS Start-End: 11-348
cattttggccatggctttgcagagcactctgggggcggtgtggctagggcttctcctcaactctctctggaaggttgcagaaagcaaggaccaagtgtttcagccttccacagtggcatcttcagagggagctgtggtggaaatcttctgtaatcactctgtgtccaatgcttacaacttcttctggtaccttcacttcccgggatgtgcaccaagactccttgttaaaggctcaaagccttctcagcagggacgatacaacatgacctatgaacggttctcttcatcgctgctcatcctccaggtgcgggaggcagatgctgctgtttactactgtgctgtggagga

SEQ ID NO: 188715 - DNA, 406 bp, Homo sapiens
  Payload ID: 17180
  Gene Symbol: TRAV20
  Gene Name: T cell receptor alpha variable 20
  ENST ID: ENST00000390448
  CDS Start-End: 70-406
acagaagtggcgcctctgagaaaagaaggttggaattatcgtaatttgtttctaggctgagataccagcatggagaaaatgttggagtgtgcattcatagtcttgtggcttcagcttggctggttgagtggagaagaccaggtgacgcagagtcccgaggccctgagactccaggagggagagagtagcagtctcaactgcagttacacagtcagcggtttaagagggctgttctggtataggcaagatcctgggaaaggccctgaattcctcttcaccctgtattcagctggggaagaaaaggagaaagaaaggctaaaagccacattaacaaagaaggaaagctttctgcacatcacagcccctaaacctgaagactcagccacttatctctgtgctgtgcagg

SEQ ID NO: 188716 - DNA, 343 bp, Homo sapiens
  Payload ID: 17181
  Gene Symbol: TRAV21
  Gene Name: T cell receptor alpha variable 21
  ENST ID: ENST00000390449
  CDS Start-End: 8-343
agaaggaatggagaccctcttgggcctgcttatcctttggctgcagctgcaatgggtgagcagcaaacaggaggtgacgcagattcctgcagctctgagtgtcccagaaggagaaaacttggttctcaactgcagtttcactgatagcgctatttacaacctccagtggtttaggcaggaccctgggaaaggtctcacatctctgttgcttattcagtcaagtcagagagagcaaacaagtggaagacttaatgcctcgctggataaatcatcaggacgtagtactttatacattgcagcttctcagcctggtgactcagccacctacctctgtgctgtgagg

SEQ ID NO: 188717 - DNA, 464 bp, Homo sapiens
  Payload ID: 17182
  Gene Symbol: TRAV22
  Gene Name: T cell receptor alpha variable 22
  ENST ID: ENST00000390450
  CDS Start-End: 134-464
ggctttgtcgggtggagctgattggttgcaggagcagcaacagttccagagccaagtcatgacaccgacctccccaaggtttagttaaatatatcttatggtgaaaatgcccggagcaagaaggcaaagcatcatgaagaggatattgggagctctgctggggctcttgagtgcccaggtttgctgtgtgagaggaatacaagtggagcagagtcctccagacctgattctccaggagggagccaattccacgctgcggtgcaatttttctgactctgtgaacaatttgcagtggtttcatcaaaacccttggggacagctcatcaacctgttttacattccctcagggacaaaacagaatggaagattaagcgccacgactgtcgctacggaacgctacagcttattgtacatttcctcttcccagaccacagactcaggcgtttatttctgtgctgtggagc

SEQ ID NO: 188718 - DNA, 409 bp, Homo sapiens
  Payload ID: 17183
  Gene Symbol: TRAV23DV6
  Gene Name: T cell receptor alpha variable 23/delta variable 6
  ENST ID: ENST00000390451
  CDS Start-End: 46-409
ctggaagaccacctgggctgtcattgagctctggtgccaggaggaatggacaagatcttaggagcatcatttttagttctgtggcttcaactatgctgggtgagtggccaacagaaggagaaaagtgaccagcagcaggtgaaacaaagtcctcaatctttgatagtccagaaaggagggatttcaattataaactgtgcttatgagaacactgcgtttgactactttccatggtaccaacaattccctgggaaaggccctgcattattgatagccatacgtccagatgtgagtgaaaagaaagaaggaagattcacaatctccttcaataaaagtgccaagcagttctcatcgcatatcatggattcccagcctggagactcagccacctacttctgtgcagcaagca

SEQ ID NO: 188719 - DNA, 343 bp, Homo sapiens
  Payload ID: 17184
  Gene Symbol: TRAV24
  Gene Name: T cell receptor alpha variable 24
  ENST ID: ENST00000390453
  CDS Start-End: 1-343
atggagaagaatcctttggcagccccattactaatcctctggtttcatcttgactgcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccttgtttgtaatgactttaaatggggatgaaaagaagaaaggacgaataagtgccactcttaataccaaggagggttacagctatttgtacatcaaaggatcccagcctgaagactcagccacatacctctgtgccttta

SEQ ID NO: 188720 - DNA, 403 bp, Homo sapiens
  Payload ID: 17185
  Gene Symbol: TRAV25
  Gene Name: T cell receptor alpha variable 25
  ENST ID: ENST00000390454
  CDS Start-End: 77-403
actatttctattgatctggaagaagcttgtaccaggcaacccatttaggagaagttggatgaagagggagagggagatgctactcatcacatcaatgttggtcttatggatgcaattgtcacaggtgaatggacaacaggtaatgcaaattcctcagtaccagcatgtacaagaaggagaggacttcaccacgtactgcaattcctcaactactttaagcaatatacagtggtataagcaaaggcctggtggacatcccgtttttttgatacagttagtgaagagtggagaagtgaagaagcagaaaagactgacatttcagtttggagaagcaaaaaagaacagctccctgcacatcacagccacccagactacagatgtaggaacctacttctgtgcaggg

SEQ ID NO: 188721 - DNA, 537 bp, Homo sapiens
  Payload ID: 17186
  Gene Symbol: TRAV26-1
  Gene Name: T cell receptor alpha variable 26-1
  ENST ID: ENST00000390455
  CDS Start-End: 210-537
aggaacatgactaaacctggggaggaagacatagaaaagcaactgctctatcattggctgacaagatcctgacaacaacacaatgagagctgcactccttgcaagtctttactagtagctgttgcttctgttctctggaaattctttaaacctagaatcagacacaaaaactgaactctgggtccacaatcctcatttgtccttgaagtatgaggctggtggcaagagtaactgtgtttctgacctttggaactataattgatgctaagaccacccagcccacctccatggattgcgctgaaggaagagctgcaaacctgccttgtaatcactctaccatcagtggaaatgagtatgtgtattggtatcgacagattcactcccaggggccacagtatatcattcatggtctaaaaaacaatgaaaccaatgaaatggcctctctgatcatcacagaagacagaaagtccagcaccttgatcctgccccacgctacgctgagagacactgctgtgtactattgcatcgtcagagtcg

SEQ ID NO: 188722 - DNA, 327 bp, Homo sapiens
  Payload ID: 17187
  Gene Symbol: TRAV26-2
  Gene Name: T cell receptor alpha variable 26-2
  ENST ID: ENST00000390460
  CDS Start-End: 1-327
atgaagttggtgacaagcattactgtactcctatctttgggtattatgggtgatgctaagaccacacagccaaattcaatggagagtaacgaagaagagcctgttcacttgccttgtaaccactccacaatcagtggaactgattacatacattggtatcgacagcttccctcccagggtccagagtacgtgattcatggtcttacaagcaatgtgaacaacagaatggcctctctggcaatcgctgaagacagaaagtccagtaccttgatcctgcaccgtgctaccttgagagatgctgctgtgtactactgcatcctgagagac

SEQ ID NO: 188723 - DNA, 425 bp, Homo sapiens
  Payload ID: 17188
  Gene Symbol: TRAV27
  Gene Name: T cell receptor alpha variable 27
  ENST ID: ENST00000390457
  CDS Start-End: 98-425
aagcactcttctagcccagagaagtctgttccaggacgggctctttcaggagcagctaaagtcaggggccatgtccaccatgtgatagaaagacaagatggtcctgaaattctccgtgtccattctttggattcagttggcatgggtgagcacccagctgctggagcagagccctcagtttctaagcatccaagagggagaaaatctcactgtgtactgcaactcctcaagtgttttttccagcttacaatggtacagacaggagcctggggaaggtcctgtcctcctggtgacagtagttacgggtggagaagtgaagaagctgaagagactaacctttcagtttggtgatgcaagaaaggacagttctctccacatcactgcagcccagactggtgatacaggcctctacctctgtgcaggag

SEQ ID NO: 188724 - DNA, 469 bp, Homo sapiens
  Payload ID: 17189
  Gene Symbol: TRAV29DV5
  Gene Name: T cell receptor alpha variable 29/delta variable 5 (gene/pseudogene)
  ENST ID: ENST00000390458
  CDS Start-End: 112-469
atatgtaaaatgaagggtctgtggaaggacatgaataaagcacaggaggttgaagtcagatttgcagctttctaggcaggagataagacaatctgcatcttcacaggagggatggccatgctcctgggggcatcagtgctgattctgtggcttcagccagactgggtaaacagtcaacagaagaatgatgaccagcaagttaagcaaaattcaccatccctgagcgtccaggaaggaagaatttctattctgaactgtgactatactaacagcatgtttgattatttcctatggtacaaaaaataccctgctgaaggtcctacattcctgatatctataagttccattaaggataaaaatgaagatggaagattcactgttttcttaaacaaaagtgccaagcacctctctctgcacattgtgccctcccagcctggagactctgcagtgtacttctgtgcagcaagcg

SEQ ID NO: 188725 - DNA, 519 bp, Homo sapiens
  Payload ID: 17190
  Gene Symbol: TRAV3
  Gene Name: T cell receptor alpha variable 3 (gene/pseudogene)
  ENST ID: ENST00000390425
  CDS Start-End: 177-519
ccggtgtcgggaagcaccagtgccctgaggaagggccatttccaaaagccctgtgctgacacagggttgctggttcctcttcaagagcccactctctggggtggggccatatctccagcagaggtgggctggaaaggacccccccaatcccgcccgccgtgagcttagctggagccatggcctctgcacccatctcgatgcttgcgatgctcttcacattgagtgggctgagagctcagtcagtggctcagccggaagatcaggtcaacgttgctgaagggaatcctctgactgtgaaatgcacctattcagtctctggaaacccttatcttttttggtatgttcaataccccaaccgaggcctccagttccttctgaaatacatcacaggggataacctggttaaaggcagctatggctttgaagctgaatttaacaagagccaaacctccttccacctgaagaaaccatctgcccttgtgagcgactccgctttgtacttctgtgctgtgagagaca

SEQ ID NO: 188726 - DNA, 337 bp, Homo sapiens
  Payload ID: 17191
  Gene Symbol: TRAV30
  Gene Name: T cell receptor alpha variable 30
  ENST ID: ENST00000557168
  CDS Start-End: 1-337
atggagactctcctgaaagtgctttcaggcaccttgttgtggcagttgacctgggtgagaagccaacaaccagtgcagagtcctcaagccgtgatcctccgagaaggggaagatgctgtcatcaactgcagttcctccaaggctttatattctgtacactggtacaggcagaagcatggtgaagcacccgtcttcctgatgatattactgaagggtggagaacagaagggtcatgacaaaatatctgcttcatttaatgaaaaaaagcagcaaagctccctgtaccttacggcctcccagctcagttactcaggaacctacttctgcggcacagaga

SEQ ID NO: 188727 - DNA, 349 bp, Homo sapiens
  Payload ID: 17192
  Gene Symbol: TRAV34
  Gene Name: T cell receptor alpha variable 34
  ENST ID: ENST00000390461
  CDS Start-End: 13-349
aatagctaagggatggagactgttctgcaagtactcctagggatattggggttccaagcagcctgggtcagtagccaagaactggagcagagtcctcagtccttgatcgtccaagagggaaagaatctcaccataaactgcacgtcatcaaagacgttatatggcttatactggtataagcaaaagtatggtgaaggtcttatcttcttgatgatgctacagaaaggtggggaagagaaaagtcatgaaaagataactgccaagttggatgagaaaaagcagcaaagttccctgcatatcacagcctcccagcccagccatgcaggcatctacctctgtggagcagaca

SEQ ID NO: 188728 - DNA, 356 bp, Homo sapiens
  Payload ID: 17193
  Gene Symbol: TRAV36DV7
  Gene Name: T cell receptor alpha variable 36/delta variable 7
  ENST ID: ENST00000390463
  CDS Start-End: 17-356
acttgataactgaaggatgatgaagtgtccacaggctttactagctatcttttggcttctactgagctgggtgagcagtgaagacaaggtggtacaaagccctctatctctggttgtccacgagggagacaccgtaactctcaattgcagttatgaagtgactaactttcgaagcctactatggtacaagcaggaaaagaaagctcccacatttctatttatgctaacttcaagtggaattgaaaagaagtcaggaagactaagtagcatattagataagaaagaacttttcagcatcctgaacatcacagccacccagaccggagactcggccatctacctctgtgctgtggagg

SEQ ID NO: 188729 - DNA, 353 bp, Homo sapiens
  Payload ID: 17194
  Gene Symbol: TRAV38-1
  Gene Name: T cell receptor alpha variable 38-1
  ENST ID: ENST00000390464
  CDS Start-End: 4-353
agcatgacacgagttagcttgctgtgggcagtcgtggtctccacctgtcttgaatccggcatggcccagacagtcactcagtctcaaccagagatgtctgtgcaggaggcagagactgtgaccctgagttgcacatatgacaccagtgagaataattattatttgttctggtacaagcagcctcccagcaggcagatgattctcgttattcgccaagaagcttataagcaacagaatgcaacggagaatcgtttctctgtgaacttccagaaagcagccaaatccttcagtctcaagatctcagactcacagctgggggacactgcgatgtatttctgtgctttcatgaagca

SEQ ID NO: 188730 - DNA, 395 bp, Homo sapiens
  Payload ID: 17195
  Gene Symbol: TRAV38-2DV8
  Gene Name: T cell receptor alpha variable 38-2/delta variable 8
  ENST ID: ENST00000390465
  CDS Start-End: 47-395
agatcagaagaggaggcttctcaccctgcagcagggacctgtgagcatggcatgccctggcttcctgtgggcacttgtgatctccacctgtcttgaatttagcatggctcagacagtcactcagtctcaaccagagatgtctgtgcaggaggcagagaccgtgaccctgagctgcacatatgacaccagtgagagtgattattatttattctggtacaagcagcctcccagcaggcagatgattctcgttattcgccaagaagcttataagcaacagaatgcaacagagaatcgtttctctgtgaacttccagaaagcagccaaatccttcagtctcaagatctcagactcacagctgggggatgccgcgatgtatttctgtgcttataggagcg

SEQ ID NO: 188731 - DNA, 331 bp, Homo sapiens
  Payload ID: 17196
  Gene Symbol: TRAV39
  Gene Name: T cell receptor alpha variable 39
  ENST ID: ENST00000390466
  CDS Start-End: 1-331
atgaagaagctactagcaatgattctgtggcttcaactagaccggttaagtggagagctgaaagtggaacaaaaccctctgttcctgagcatgcaggagggaaaaaactataccatctactgcaattattcaaccacttcagacagactgtattggtacaggcaggatcctgggaaaagtctggaatctctgtttgtgttgctatcaaatggagcagtgaagcaggagggacgattaatggcctcacttgataccaaagcccgtctcagcaccctccacatcacagctgccgtgcatgacctctctgccacctacttctgtgccgtggaca

SEQ ID NO: 188732 - DNA, 395 bp, Homo sapiens
  Payload ID: 17197
  Gene Symbol: TRAV4
  Gene Name: T cell receptor alpha variable 4
  ENST ID: ENST00000390426
  CDS Start-End: 68-395
ctgggctcattgcagctcagacacagcaaaagagcctagaacctgggtcctagtttgcacctagaatatgaggcaagtggcgagagtgatcgtgttcctgaccctgagtactttgagccttgctaagaccacccagcccatctccatggactcatatgaaggacaagaagtgaacataacctgtagccacaacaacattgctacaaatgattatatcacgtggtaccaacagtttcccagccaaggaccacgatttattattcaaggatacaagacaaaagttacaaacgaagtggcctccctgtttatccctgccgacagaaagtccagcactctgagcctgccccgggtttccctgagcgacactgctgtgtactactgcctcgtgggtgaca

SEQ ID NO: 188733 - DNA, 317 bp, Homo sapiens
  Payload ID: 17198
  Gene Symbol: TRAV40
  Gene Name: T cell receptor alpha variable 40
  ENST ID: ENST00000390467
  CDS Start-End: 1-317
atgaactcctctctggactttctaattctgatcttaatgtttggaggaaccagcagcaattcagtcaagcagacgggccaaataaccgtctcggagggagcatctgtgactatgaactgcacatacacatccacggggtaccctacccttttctggtatgtggaataccccagcaaacctctgcagcttcttcagagagagacaatggaaaacagcaaaaacttcggaggcggaaatattaaagacaaaaactcccccattgtgaaatattcagtccaggtatcagactcagccgtgtactactgtcttctgggaga

SEQ ID NO: 188734 - DNA, 336 bp, Homo sapiens
  Payload ID: 17199
  Gene Symbol: TRAV41
  Gene Name: T cell receptor alpha variable 41
  ENST ID: ENST00000390468
  CDS Start-End: 1-336
atggtgaagatccggcaatttttgttggctattttgtggcttcagctaagctgtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcaga

SEQ ID NO: 188735 - DNA, 352 bp, Homo sapiens
  Payload ID: 17200
  Gene Symbol: TRAV5
  Gene Name: T cell receptor alpha variable 5
  ENST ID: ENST00000390427
  CDS Start-End: 13-352
gtggggagaacaatgaagacatttgctggattttcgttcctgtttttgtggctgcagctggactgtatgagtagaggagaggatgtggagcagagtcttttcctgagtgtccgagagggagacagctccgttataaactgcacttacacagacagctcctccacctacttatactggtataagcaagaacctggagcaggtctccagttgctgacgtatattttttcaaatatggacatgaaacaagaccaaagactcactgttctattgaataaaaaggataaacatctgtctctgcgcattgcagacacccagactggggactcagctatctacttctgtgcagagagta

SEQ ID NO: 188736 - DNA, 404 bp, Homo sapiens
  Payload ID: 17201
  Gene Symbol: TRAV6
  Gene Name: T cell receptor alpha variable 6
  ENST ID: ENST00000390428
  CDS Start-End: 8-404
aaacagaatggctttttggctgagaagcctgggtctacatttcaggccacatttggggagacgaatggagtcattcctgggaggtgttttgctgattttgtggcttcaagtggactgggtgaagagccaaaagatagaacagaattccgaggctctgaacattcaggagggtaaaacggccaccctgacctgcaactatacaaactattctccagcatacttacagtggtaccgacaagatccaggaagaggccctgttttcttgctactcatacgtgaaaatgagaaagaaaaaaggaaagaaagactgaaggtcacctttgataccacccttaaacagagtttgtttcatatcacagcctcccagcctgcagactcagctacctacctctgtgctctagaca

SEQ ID NO: 188737 - DNA, 337 bp, Homo sapiens
  Payload ID: 17202
  Gene Symbol: TRAV7
  Gene Name: T cell receptor alpha variable 7
  ENST ID: ENST00000390429
  CDS Start-End: 1-337
atggagaagatgcggagacctgtcctaattatattttgtctatgtcttggctgggcaaatggagaaaaccaggtggagcacagccctcattttctgggaccccagcagggagacgttgcctccatgagctgcacgtactctgtcagtcgttttaacaatttgcagtggtacaggcaaaatacagggatgggtcccaaacacctattatccatgtattcagctggatatgagaagcagaaaggaagactaaatgctacattactgaagaatggaagcagcttgtacattacagccgtgcagcctgaagattcagccacctatttctgtgctgtagatg

SEQ ID NO: 188738 - DNA, 473 bp, Homo sapiens
  Payload ID: 17203
  Gene Symbol: TRAV8-1
  Gene Name: T cell receptor alpha variable 8-1
  ENST ID: ENST00000390430
  CDS Start-End: 133-473
ccaaaacaagagacttgcctagcccaaccttcctcacgctcgctattctcaagacctgggttccagccactttcctactggccccgaggagaatttccaaagagacgcctgcagtgtttccacagctcagccatgctcctgttgctcataccagtgctggggatgatttttgccctgagagatgccagagcccagtctgtgagccagcataaccaccacgtaattctctctgaagcagcctcactggagttgggatgcaactattcctatggtggaactgttaatctcttctggtatgtccagtaccctggtcaacaccttcagcttctcctcaagtacttttcaggggatccactggttaaaggcatcaagggctttgaggctgaatttataaagagtaaattctcctttaatctgaggaaaccctctgtgcagtggagtgacacagctgagtacttctgtgccgtgaatgc

SEQ ID NO: 188739 - DNA, 566 bp, Homo sapiens
  Payload ID: 17204
  Gene Symbol: TRAV8-2
  Gene Name: T cell receptor alpha variable 8-2
  ENST ID: ENST00000390434
  CDS Start-End: 226-566
ggctgatgtagctcactgatgtctgtgtagatagggagctgtgacgagagcaagaggtcagaacacatccagactccttaagagaaagcctttctgttttggaaacttttcaaagccagggacttgtccagcccaacctccccattgctcctagctcccgaggctcaggacccctggcttctgtcctccctgctcagggtcctgcagcgttgcctctgctcagccatgctcctgctgctcgtcccagtgctcgaggtgatttttaccctgggaggaaccagagcccagtcggtgacccagcttgacagccacgtctctgtctctgaaggaaccccggtgctgctgaggtgcaactactcatcttcttattcaccgtctctcttctggtatgtgcaacaccccaacaaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgttgtgagtga

SEQ ID NO: 188740 - DNA, 341 bp, Homo sapiens
  Payload ID: 17205
  Gene Symbol: TRAV8-3
  Gene Name: T cell receptor alpha variable 8-3
  ENST ID: ENST00000390435
  CDS Start-End: 1-341
atgctcctggagcttatcccactgctggggatacattttgtcctgagaactgccagagcccagtcagtgacccagcctgacatccacatcactgtctctgaaggagcctcactggagttgagatgtaactattcctatggggcaacaccttatctcttctggtatgtccagtcccccggccaaggcctccagctgctcctgaagtacttttcaggagacactctggttcaaggcattaaaggctttgaggctgaatttaagaggagtcaatcttccttcaatctgaggaaaccctctgtgcattggagtgatgctgctgagtacttctgtgctgtgggtgc

SEQ ID NO: 188741 - DNA, 469 bp, Homo sapiens
  Payload ID: 17206
  Gene Symbol: TRAV8-4
  Gene Name: T cell receptor alpha variable 8-4
  ENST ID: ENST00000390438
  CDS Start-End: 129-469
ttttgaaacccttcaaaggcagagacttgtccagcctaacctgcctgctgctcctagctcctgaggctcagggcccttggcttctgtccgctctgctcagggccctccagcgtggccactgctcagccatgctcctgctgctcgtcccagtgctcgaggtgatttttaccctgggaggaaccagagcccagtcggtgacccagcttggcagccacgtctctgtctctgaaggagccctggttctgctgaggtgcaactactcatcgtctgttccaccatatctcttctggtatgtgcaataccccaaccaaggactccagcttctcctgaagtacacatcagcggccaccctggttaaaggcatcaacggttttgaggctgaatttaagaagagtgaaacctccttccacctgacgaaaccctcagcccatatgagcgacgcggctgagtacttctgtgctgtgagtga

SEQ ID NO: 188742 - DNA, 561 bp, Homo sapiens
  Payload ID: 17207
  Gene Symbol: TRAV8-6
  Gene Name: T cell receptor alpha variable 8-6
  ENST ID: ENST00000390443
  CDS Start-End: 221-561
gtagctcgttgatgtctgtgtggatagggagctgtgacgagagcaagaggtcagaacacatccaggctccttaagggaaagcctctttctgtttctgaaacttttcaaagccagggacttgtccaatccaacctcctcacagttcctagctcctgaggctcagcgcccttggcttctgtccgcccagcttaaggtcctgcagcattgccactgctcagccatgctcctgctgctcgtcccagcgttccaggtgatttttaccctgggaggaaccagagcccagtctgtgacccagcttgacagccaagtccctgtctttgaagaagcccctgtggagctgaggtgcaactactcatcgtctgtttcagtgtatctcttctggtatgtgcaataccccaaccaaggactccagcttctcctgaagtatttatcaggatccaccctggttgaaagcatcaacggttttgaggctgaatttaacaagagtcaaacttccttccacttgaggaaaccctcagtccatataagcgacacggctgagtacttctgtgctgtgagtga

SEQ ID NO: 188743 - DNA, 341 bp, Homo sapiens
  Payload ID: 17208
  Gene Symbol: TRAV8-7
  Gene Name: T cell receptor alpha variable 8-7 (non-functional)
  ENST ID: ENST00000390456
  CDS Start-End: 1-341
atgctcttagtggtcattctgctgcttggaatgttcttcacactgagtaaaacccagtcggtgacccagcttgatggccacatcactgtctctgaagaagcccctctggaactgaagtgcaactattcctatagtggagttccttctctcttctggtatgtccaatactctagccaaagcctccagcttctcctcaaagacctaacaaaggccacccaggttaaaggcatcagaggttttgaggctgaatttaagaagagcgaaacctccttctacctgaggaaaccatcaacccatgtgagtgatgctgctgagtacttctgtgctgtgggtgacaggag

SEQ ID NO: 188744 - DNA, 338 bp, Homo sapiens
  Payload ID: 17209
  Gene Symbol: TRAV9-1
  Gene Name: T cell receptor alpha variable 9-1
  ENST ID: ENST00000390431
  CDS Start-End: 1-338
atgaattcttctccaggaccagcgattgcactattcttaatgtttgggggaatcaatggagattcagtggtccagacagaaggccaagtgctcccctctgaaggggattccctgattgtgaactgctcctatgaaaccacacagtacccttcccttttttggtatgtccaatatcctggagaaggtccacagctccacctgaaagccatgaaggccaatgacaagggaaggaacaaaggttttgaagccatgtaccgtaaagaaaccacttctttccacttggagaaagactcagttcaagagtcagactccgctgtgtacttctgtgctctgagtga

SEQ ID NO: 188745 - DNA, 394 bp, Homo sapiens
  Payload ID: 17210
  Gene Symbol: TRAV9-2
  Gene Name: T cell receptor alpha variable 9-2
  ENST ID: ENST00000390441
  CDS Start-End: 57-394
cactgtgatttcttcatgttaaggatcaagaccattatttgggtaacacactaaagatgaactattctccaggcttagtatctctgatactcttactgcttggaagaacccgtggagattcagtgacccagatggaagggccagtgactctctcagaagaggccttcctgactataaactgcacgtacacagccacaggatacccttcccttttctggtatgtccaatatcctggagaaggtctacagctcctcctgaaagccacgaaggctgatgacaagggaagcaacaaaggttttgaagccacataccgtaaagaaaccacttctttccacttggagaaaggctcagttcaagtgtcagactcagcggtgtacttctgtgctctgagtga

SEQ ID NO: 188746 - DNA, 1919 bp, Homo sapiens
  Payload ID: 17211
  Gene Symbol: TRAT1
  Gene Name: T cell receptor associated transmembrane adaptor 1
  Uniprot ID: Q6PIZ9
  ENST ID: ENST00000295756
  CDS Start-End: 231-791
aagacaactccttcaccacatttcctgtttgtaactgaaacaaagtacacacaaaagattttaagaaacagaagagaaaagaatccgaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcaggaatctctgggtgcccctttttcctctggggacttctagcattgttgggcttggctttggttatatcactgatcttcaatatttcccactatgtggaaaagcaacgacaagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcactgtcttctctctgtttcatcagaaacacatactataatacttgtctctgtccttaagtgtgatacacgctatttttctgattgttaagactttccttattactggttctaatttgattataatatgccaaggtatggt

SEQ ID NO: 188747 - DNA, 1596 bp, Homo sapiens
  Payload ID: 17211
  Gene Symbol: TRAT1
  Gene Name: T cell receptor associated transmembrane adaptor 1
  ENST ID: ENST00000426646
  CDS Start-End: 157-606
agaaaagaatccgaggcacagataaagataagttttactgtcatgctgcttttaacataacagagcaacatcacctaggaaaaaagtttgtaggaggatttttaatccatatatttgtcttatggctagataaagatttctctgaaaaaaagaagcatgtcagataaaatgtacagctactccagtgaccacaccagggttgatgagtattatattgaagacacaccaatttatggtaacttagatgatatgatttcagaaccaatggatgaaaattgctatgaacaaatgaaagcccgaccagagaaatctgtaaataagatgcaggaagccaccccatctgcacaggcaaccaatgaaacacagatgtgctacgcctcacttgatcacagcgttaaggggaagcgtagaaagcccaggaaacagaatactcatttctcagacaaggatggagatgagcaactacatgcaatagatgccagcgtttctaagaccaccttagtagacagtttctccccagaaagccaggcagtagaggaaaacattcatgatgatcccatcagactgtttggattgatccgtgctaagagagaacctataaactagctggaccatgatctagttcaatgatttggctcctattgaagatggcttctaagaaaacaagatgcacagaggacacagaaggacttggcagcagggtgatgacctgatcatttgttgatgggatggtggcttacctcttattcacagcttacacttatgcatgccaaatgtaaggccatgaaaatcagtatttcaaataacttaaaaaatgctttactactaaaatgtaaaaaattaatgtgctcacctcggcagcacatatactaaaaattaataagacccagcttgaaaattgagcctgataacaagattacaaattcacaatacctaatacttagggaaatataaaaatttaagcatgaatgtgttctggaacacgttagaagaaaaataaaagccaatgagtttttttttaattctcctttctcaccaatgggcaatagcccataattgaaataaatttctgattgaaaggtataggaaacattaaaatgcattactaagagaagtaatataattttcttacaaagtatttttcccaaagatagctttactatttcaaaaattgtcaaattaatgcatgctccttacaacaaacaaatatcaaaaagagtttaggaattctactagccagagatagtcacttggagaaactttctatatatccttctaaatatttttctgggcatgcttatgtatgtacatcagttgtttctttttattttgaaccaaaaatgtggtttcttttgtacacattacttaaactttctttccagtcaacaatatattgtggatttattttcactgttatatttaactatatataaatacgcatatattgtaattttaatgtctgcttagcaccccactgataaccaaatcacagtttatttaaataattttaatgacttttcaaaaacaatttattgatgcaaaaagcaaggttgagatgacaatgtttctttcaataattaaaaaatactgcttcac

SEQ ID NO: 188748 - DNA, 1054 bp, Homo sapiens
  Payload ID: 17212
  Gene Symbol: TRBC1
  Gene Name: T cell receptor beta constant 1
  ENST ID: ENST00000613903
  CDS Start-End: 11-940
caaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagctgcatcctctgttcggggaccaggttaaccgttgtagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggtttcaatacacattcttcttttgccagcgcttctgaagagctgctctcacctctctgcatcccaatagat

SEQ ID NO: 188749 - DNA, 1054 bp, Homo sapiens
  Payload ID: 17212
  Gene Symbol: TRBC1
  Gene Name: T cell receptor beta constant 1
  ENST ID: ENST00000610416
  CDS Start-End: 11-940
caaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatgcacagcgcagcacagccgcatcctctgttcggggaccaggttaaccgttgtagaggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggtttcaatacacattcttcttttgccagcgcttctgaagagctgctctcacctctctgcatcccaatagat

SEQ ID NO: 188750 - DNA, 933 bp, Homo sapiens
  Payload ID: 17212
  Gene Symbol: TRBC1
  Gene Name: T cell receptor beta constant 1
  ENST ID: ENST00000613594
  CDS Start-End: 1-933
atgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtatgcacagcgcagctgcatcctctctgcactttgggaacgggaccaggctcactgtgacagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctga

SEQ ID NO: 188751 - DNA, 760 bp, Homo sapiens
  Payload ID: 17212
  Gene Symbol: TRBC1
  Gene Name: T cell receptor beta constant 1
  ENST ID: ENST00000633705
  CDS Start-End: 1-533
aggacctgaacaaggtgttcccacccgaggtcgctgtgtttgagccatcagaagcagagatctcccacacccaaaaggccacactggtgtgcctggccacaggcttcttccctgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctga

SEQ ID NO: 188752 - DNA, 760 bp, Homo sapiens
  Payload ID: 17212
  Gene Symbol: TRBC1
  Gene Name: T cell receptor beta constant 1
  ENST ID: ENST00000632136
  CDS Start-End: 1-533
aggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacggacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctga

SEQ ID NO: 188753 - DNA, 758 bp, Homo sapiens
  Payload ID: 17213
  Gene Symbol: TRBC2
  Gene Name: T cell receptor beta constant 2
  ENST ID: ENST00000466254
  CDS Start-End: 1-539
aggacctgaaaaacgtgttcccacccaaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaattgtgtgttgggcctggttgcattt

SEQ ID NO: 188754 - DNA, 933 bp, Homo sapiens
  Payload ID: 17213
  Gene Symbol: TRBC2
  Gene Name: T cell receptor beta constant 2
  ENST ID: ENST00000613720
  CDS Start-End: 1-933
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagtagtatagacacagacgagcagtacgtcgggccgggcaccaggctcacggtcacagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 188755 - DNA, 936 bp, Homo sapiens
  Payload ID: 17213
  Gene Symbol: TRBC2
  Gene Name: T cell receptor beta constant 2
  ENST ID: ENST00000621068
  CDS Start-End: 1-936
atgggcccccagctccttggctatgtggtcctttgccttctaggagcaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatccacagtgttgcacagccagtacttcgggccaggcacgcggctcctggtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 188756 - DNA, 755 bp, Homo sapiens
  Payload ID: 17213
  Gene Symbol: TRBC2
  Gene Name: T cell receptor beta constant 2
  ENST ID: ENST00000622053
  CDS Start-End: 1-539
aggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaattgtgtgttgggcctggttgca

SEQ ID NO: 188757 - DNA, 945 bp, Homo sapiens
  Payload ID: 17213
  Gene Symbol: TRBC2
  Gene Name: T cell receptor beta constant 2
  ENST ID: ENST00000620987
  CDS Start-End: 1-945
atgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaatggctcgggggccgtgaccaagagacccagtacttcgggccaggcacgcggctcctggtgctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 188758 - DNA, 948 bp, Homo sapiens
  Payload ID: 17213
  Gene Symbol: TRBC2
  Gene Name: T cell receptor beta constant 2
  ENST ID: ENST00000614992
  CDS Start-End: 1-948
atgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaagcacaatatcgaagtccctcctacaatgagcagttcttcgggccagggacacggctcaccgtgctagaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 188759 - DNA, 942 bp, Homo sapiens
  Payload ID: 17213
  Gene Symbol: TRBC2
  Gene Name: T cell receptor beta constant 2
  ENST ID: ENST00000612153
  CDS Start-End: 1-942
atgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagttccccgctgtgctctggggccaacgtcctgactttcggggccggcagcaggctgaccgtgctggaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 188760 - DNA, 12 bp, Homo sapiens
  Payload ID: 17214
  Gene Symbol: TRBD1
  Gene Name: T cell receptor beta diversity 1
  ENST ID: ENST00000632684
  CDS Start-End: 1-12
gggacagggggc

SEQ ID NO: 188761 - DNA, 12 bp, Homo sapiens
  Payload ID: 17214
  Gene Symbol: TRBD1
  Gene Name: T cell receptor beta diversity 1
  ENST ID: ENST00000631435
  CDS Start-End: 1-12
gggacagggggc

SEQ ID NO: 188762 - DNA, 48 bp, Homo sapiens
  Payload ID: 17215
  Gene Symbol: TRBJ1-1
  Gene Name: T cell receptor beta joining 1-1
  ENST ID: ENST00000634213
  CDS Start-End: 1-48
tgaacactgaagctttctttggacaaggcaccagactcacagttgtag

SEQ ID NO: 188763 - DNA, 48 bp, Homo sapiens; identical to SEQ ID NO: 188762
  Payload ID: 17215
  Gene Symbol: TRBJ1-1
  Gene Name: T cell receptor beta joining 1-1
  ENST ID: ENST00000632951
  CDS Start-End: 1-48

SEQ ID NO: 188764 - DNA, 48 bp, Homo sapiens
  Payload ID: 17216
  Gene Symbol: TRBJ1-2
  Gene Name: T cell receptor beta joining 1-2
  ENST ID: ENST00000631745
  CDS Start-End: 1-48
ctaactatggctacaccttcggttcggggaccaggttaaccgttgtag

SEQ ID NO: 188765 - DNA, 48 bp, Homo sapiens; identical to SEQ ID NO: 188764
  Payload ID: 17216
  Gene Symbol: TRBJ1-2
  Gene Name: T cell receptor beta joining 1-2
  ENST ID: ENST00000633553
  CDS Start-End: 1-48

SEQ ID NO: 188766 - DNA, 50 bp, Homo sapiens
  Payload ID: 17217
  Gene Symbol: TRBJ1-3
  Gene Name: T cell receptor beta joining 1-3
  ENST ID: ENST00000633780
  CDS Start-End: 1-50
ctctggaaacaccatatattttggagagggaagttggctcactgttgtag

SEQ ID NO: 188767 - DNA, 50 bp, Homo sapiens; identical to SEQ ID NO: 188766
  Payload ID: 17217
  Gene Symbol: TRBJ1-3
  Gene Name: T cell receptor beta joining 1-3
  ENST ID: ENST00000633936
  CDS Start-End: 1-50

SEQ ID NO: 188768 - DNA, 51 bp, Homo sapiens
  Payload ID: 17218
  Gene Symbol: TRBJ1-4
  Gene Name: T cell receptor beta joining 1-4
  ENST ID: ENST00000633891
  CDS Start-End: 1-51
caactaatgaaaaactgttttttggcagtggaacccagctctctgtcttgg

SEQ ID NO: 188769 - DNA, 51 bp, Homo sapiens; identical to SEQ ID NO: 188768
  Payload ID: 17218
  Gene Symbol: TRBJ1-4
  Gene Name: T cell receptor beta joining 1-4
  ENST ID: ENST00000632041
  CDS Start-End: 1-51

SEQ ID NO: 188770 - DNA, 50 bp, Homo sapiens
  Payload ID: 17219
  Gene Symbol: TRBJ1-5
  Gene Name: T cell receptor beta joining 1-5
  ENST ID: ENST00000633507
  CDS Start-End: 1-50
tagcaatcagccccagcattttggtgatgggactcgactctccatcctag

SEQ ID NO: 188771 - DNA, 50 bp, Homo sapiens; identical to SEQ ID NO: 188770
  Payload ID: 17219
  Gene Symbol: TRBJ1-5
  Gene Name: T cell receptor beta joining 1-5
  ENST ID: ENST00000634000
  CDS Start-End: 1-50

SEQ ID NO: 188772 - DNA, 53 bp, Homo sapiens
  Payload ID: 17220
  Gene Symbol: TRBJ1-6
  Gene Name: T cell receptor beta joining 1-6
  ENST ID: ENST00000632228
  CDS Start-End: 1-53
ctcctataattcacccctccactttgggaacgggaccaggctcactgtgacag

SEQ ID NO: 188773 - DNA, 53 bp, Homo sapiens
  Payload ID: 17220
  Gene Symbol: TRBJ1-6
  Gene Name: T cell receptor beta joining 1-6
  ENST ID: ENST00000633713
  CDS Start-End: 1-53
ctcctataattcacccctccactttgggaatgggaccaggctcactgtgacag

SEQ ID NO: 188774 - DNA, 50 bp, Homo sapiens
  Payload ID: 17221
  Gene Symbol: TRBJ2-1
  Gene Name: T cell receptor beta joining 2-1
  ENST ID: ENST00000390412
  CDS Start-End: 1-50
ctcctacaatgagcagttcttcgggccagggacacggctcaccgtgctag

SEQ ID NO: 188775 - DNA, 50 bp, Homo sapiens; identical to SEQ ID NO: 188774
  Payload ID: 17221
  Gene Symbol: TRBJ2-1
  Gene Name: T cell receptor beta joining 2-1
  ENST ID: ENST00000631600
  CDS Start-End: 1-50

SEQ ID NO: 188776 - DNA, 51 bp, Homo sapiens
  Payload ID: 17222
  Gene Symbol: TRBJ2-2
  Gene Name: T cell receptor beta joining 2-2
  ENST ID: ENST00000390413
  CDS Start-End: 1-51
cgaacaccggggagctgttttttggagaaggctctaggctgaccgtactgg

SEQ ID NO: 188777 - DNA, 51 bp, Homo sapiens; identical to SEQ ID NO: 188776
  Payload ID: 17222
  Gene Symbol: TRBJ2-2
  Gene Name: T cell receptor beta joining 2-2
  ENST ID: ENST00000633188
  CDS Start-End: 1-51

SEQ ID NO: 188778 - DNA, 46 bp, Homo sapiens
  Payload ID: 17223
  Gene Symbol: TRBJ2-2P
  Gene Name: T cell receptor beta joining 2-2P (non-functional)
  ENST ID: ENST00000390414
  CDS Start-End: 1-46
ctgagaggcgctgctgggcgtctgggcggaggactcctggttctgg

SEQ ID NO: 188779 - DNA, 46 bp, Homo sapiens; identical to SEQ ID NO: 188778
  Payload ID: 17223
  Gene Symbol: TRBJ2-2P
  Gene Name: T cell receptor beta joining 2-2P (non-functional)
  ENST ID: ENST00000633209
  CDS Start-End: 1-46

SEQ ID NO: 188780 - DNA, 49 bp, Homo sapiens
  Payload ID: 17224
  Gene Symbol: TRBJ2-3
  Gene Name: T cell receptor beta joining 2-3
  ENST ID: ENST00000390415
  CDS Start-End: 1-49
agcacagatacgcagtattttggcccaggcacccggctgacagtgctcg

SEQ ID NO: 188781 - DNA, 49 bp, Homo sapiens; identical to SEQ ID NO: 188780
  Payload ID: 17224
  Gene Symbol: TRBJ2-3
  Gene Name: T cell receptor beta joining 2-3
  ENST ID: ENST00000631840
  CDS Start-End: 1-49

SEQ ID NO: 188782 - DNA, 50 bp, Homo sapiens
  Payload ID: 17225
  Gene Symbol: TRBJ2-4
  Gene Name: T cell receptor beta joining 2-4
  ENST ID: ENST00000390416
  CDS Start-End: 1-50
agccaaaaacattcagtacttcggcgccgggacccggctctcagtgctgg

SEQ ID NO: 188783 - DNA, 50 bp, Homo sapiens; identical to SEQ ID NO: 188782
  Payload ID: 17225
  Gene Symbol: TRBJ2-4
  Gene Name: T cell receptor beta joining 2-4
  ENST ID: ENST00000633836
  CDS Start-End: 1-50

SEQ ID NO: 188784 - DNA, 48 bp, Homo sapiens
  Payload ID: 17226
  Gene Symbol: TRBJ2-5
  Gene Name: T cell receptor beta joining 2-5
  ENST ID: ENST00000390417
  CDS Start-End: 1-48
accaagagacccagtacttcgggccaggcacgcggctcctggtgctcg

SEQ ID NO: 188785 - DNA, 48 bp, Homo sapiens; identical to SEQ ID NO: 188784
  Payload ID: 17226
  Gene Symbol: TRBJ2-5
  Gene Name: T cell receptor beta joining 2-5
  ENST ID: ENST00000634149
  CDS Start-End: 1-48

SEQ ID NO: 188786 - DNA, 53 bp, Homo sapiens
  Payload ID: 17227
  Gene Symbol: TRBJ2-6
  Gene Name: T cell receptor beta joining 2-6
  ENST ID: ENST00000390418
  CDS Start-End: 1-53
ctctggggccaacgtcctgactttcggggccggcagcaggctgaccgtgctgg

SEQ ID NO: 188787 - DNA, 53 bp, Homo sapiens; identical to SEQ ID NO: 188786
  Payload ID: 17227
  Gene Symbol: TRBJ2-6
  Gene Name: T cell receptor beta joining 2-6
  ENST ID: ENST00000632996
  CDS Start-End: 1-53

SEQ ID NO: 188788 - DNA, 47 bp, Homo sapiens
  Payload ID: 17228
  Gene Symbol: TRBJ2-7
  Gene Name: T cell receptor beta joining 2-7
  ENST ID: ENST00000390419
  CDS Start-End: 1-47
ctcctacgagcagtacttcgggccgggcaccaggctcacggtcacag

SEQ ID NO: 188789 - DNA, 47 bp, Homo sapiens
  Payload ID: 17228
  Gene Symbol: TRBJ2-7
  Gene Name: T cell receptor beta joining 2-7
  ENST ID: ENST00000633660
  CDS Start-End: 1-47
ctcctacgagcagtacgtcgggccgggcaccaggctcacggtcacag

SEQ ID NO: 188790 - DNA, 412 bp, Homo sapiens
  Payload ID: 17229
  Gene Symbol: TRBV10-1
  Gene Name: T cell receptor beta variable 10-1(gene/pseudogene)
  ENST ID: ENST00000390364
  CDS Start-End: 69-412
actgagagcccaacttcagtctgcccacagcagggctgggagacacaagatcctgccctggagctgaaatgggcacgaggctcttcttctatgtggccctttgtctgctgtgggcaggacacagggatgctgaaatcacccagagcccaagacacaagatcacagagacaggaaggcaggtgaccttggcgtgtcaccagacttggaaccacaacaatatgttctggtatcgacaagacctgggacatgggctgaggctgatccattactcatatggtgttcacgacactaacaaaggagaagtctcagatggctacagtgtctctagatcaaacacagaggacctccccctcactctggagtctgctgcctcctcccagacatctgtatatttctgcgccagcagtgagtc

SEQ ID NO: 188791 - DNA, 412 bp, Homo sapiens; identical to SEQ ID NO: 188790
  Payload ID: 17229
  Gene Symbol: TRBV10-1
  Gene Name: T cell receptor beta variable 10-1(gene/pseudogene)
  ENST ID: ENST00000632248
  CDS Start-End: 69-412

SEQ ID NO: 188792 - DNA, 395 bp, Homo sapiens
  Payload ID: 17230
  Gene Symbol: TRBV10-2
  Gene Name: T cell receptor beta variable 10-2
  ENST ID: ENST00000426318
  CDS Start-End: 52-395
aatttgcccacagcagggctgggagacacaagatcctgccctggagctgaaatgggcaccaggctcttcttctatgtggccctttgtctgctgtgggcaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctacgttgtctccagatccaagacagagaatttccccctcactctggagtcagctacccgctcccagacatctgtgtatttctgcgccagcagtgagtc

SEQ ID NO: 188793 - DNA, 395 bp, Homo sapiens
  Payload ID: 17230
  Gene Symbol: TRBV10-2
  Gene Name: T cell receptor beta variable 10-2
  ENST ID: ENST00000633575
  CDS Start-End: 52-395
aatttgcccacagcagggctgggagacacaagatcctgccctggagctgaaatgggcaccaggctcttcttctatgtggccctttgtctgctgtgggcaggacacagggatgctggaatcacccagagcccaagatacaagatcacagagacaggaaggcaggtgaccttgatgtgtcaccagacttggagccacagctatatgttctggtatcgacaagacctgggacatgggctgaggctgatctattactcagcagctgctgatattacagataaaggagaagtccccgatggctatgttgtctccagatccaagacagagaatttccccctcactctggagtcagctacccgctcccagacatctgtgtatttctgcgccagcagtgagtc

SEQ ID NO: 188794 - DNA, 368 bp, Homo sapiens
  Payload ID: 17231
  Gene Symbol: TRBV10-3
  Gene Name: T cell receptor beta variable 10-3
  ENST ID: ENST00000611462
  CDS Start-End: 25-368
atgagatcctggcctggacctgaaatgggcacaaggttgttcttctatgtggccctttgtctcctgtggacaggacacatggatgctggaatcacccagagcccaagacacaaggtcacagagacaggaacaccagtgactctgagatgtcaccagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagtc

SEQ ID NO: 188795 - DNA, 344 bp, Homo sapiens
  Payload ID: 17231
  Gene Symbol: TRBV10-3
  Gene Name: T cell receptor beta variable 10-3
  ENST ID: ENST00000631471
  CDS Start-End: 1-344
atgggcacaaggttgttcttctatgtggccctttgtctcctgtggacaggacacatggatgctggaatcacccagagcccaagacacaaggtcacagagacaggaacaccagtgactctgagatgtcatcagactgagaaccaccgctatatgtactggtatcgacaagacccggggcatgggctgaggctgatccattactcatatggtgttaaagatactgacaaaggagaagtctcagatggctatagtgtctctagatcaaagacagaggatttcctcctcactctggagtccgctaccagctcccagacatctgtgtacttctgtgccatcagtgagtc

SEQ ID NO: 188796 - DNA, 364 bp, Homo sapiens
  Payload ID: 17232
  Gene Symbol: TRBV11-1
  Gene Name: T cell receptor beta variable 11-1
  ENST ID: ENST00000390367
  CDS Start-End: 18-364
cctgccctgaccctgccatgagcaccaggcttctctgctggatggccctctgtctcctgggggcagaactctcagaagctgaagttgcccagtcccccagatataagattacagagaaaagccaggctgtggctttttggtgtgatcctatttctggccatgctaccctttactggtaccggcagatcctgggacagggcccggagcttctggttcaatttcaggatgagagtgtagtagatgattcacagttgcctaaggatcgattttctgcagagaggctcaaaggagtagactccactctcaagatccagcctgcagagcttggggactcggccatgtatctctgtgccagcagcttagc

SEQ ID NO: 188797 - DNA, 364 bp, Homo sapiens; identical to SEQ ID NO: 188796
  Payload ID: 17232
  Gene Symbol: TRBV11-1
  Gene Name: T cell receptor beta variable 11-1
  ENST ID: ENST00000634176
  CDS Start-End: 18-364

SEQ ID NO: 188798 - DNA, 392 bp, Homo sapiens
  Payload ID: 17233
  Gene Symbol: TRBV11-3
  Gene Name: T cell receptor beta variable 11-3
  ENST ID: ENST00000611787
  CDS Start-End: 46-392
agtgaccctgatctggcaaagcttccatcctgccctgaccctgccatgggtaccaggctcctctgctgggtggccttctgtctcctggtggaagaactcatagaagctggagtggttcagtctcccagatataagattatagagaaaaaacagcctgtggctttttggtgcaatcctatttctggccacaataccctttactggtacctgcagaacttgggacagggcccggagcttctgattcgatatgagaatgaggaagcagtagacgattcacagttgcctaaggatcgattttctgcagagaggctcaaaggagtagactccactctcaagatccagcctgcagagcttggggactcggccgtgtatctctgtgccagcagcttaga

SEQ ID NO: 188799 - DNA, 392 bp, Homo sapiens; identical to SEQ ID NO: 188798
  Payload ID: 17233
  Gene Symbol: TRBV11-3
  Gene Name: T cell receptor beta variable 11-3
  ENST ID: ENST00000634111
  CDS Start-End: 46-392

SEQ ID NO: 188800 - DNA, 409 bp, Homo sapiens
  Payload ID: 17234
  Gene Symbol: TRBV12-3
  Gene Name: T cell receptor beta variable 12-3
  ENST ID: ENST00000620569
  CDS Start-End: 63-409
ttctttgctcatgctcacagagggcctggtctagaatattccacatctgctctcactctgccatggactcctggaccttctgctgtgtgtccctttgcatcctggtagcgaagcatacagatgctggagttatccagtcaccccgccatgaggtgacagagatgggacaagaagtgactctgagatgtaaaccaatttcaggccacaactcccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagc

SEQ ID NO: 188801 - DNA, 409 bp, Homo sapiens; identical to SEQ ID NO: 188800
  Payload ID: 17234
  Gene Symbol: TRBV12-3
  Gene Name: T cell receptor beta variable 12-3
  ENST ID: ENST00000633292
  CDS Start-End: 63-409

SEQ ID NO: 188802 - DNA, 406 bp, Homo sapiens
  Payload ID: 17235
  Gene Symbol: TRBV12-4
  Gene Name: T cell receptor beta variable 12-4
  ENST ID: ENST00000617347
  CDS Start-End: 60-406
tttgctcatgttcacagagggcctggtctggaatattccacatctgctctcactctgccatgggctcctggaccctctgctgtgtgtccctttgcatcctggtagcaaagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagc

SEQ ID NO: 188803 - DNA, 406 bp, Homo sapiens
  Payload ID: 17235
  Gene Symbol: TRBV12-4
  Gene Name: T cell receptor beta variable 12-4
  ENST ID: ENST00000631824
  CDS Start-End: 60-406
tttgctcatgttcacagagggcctggtctggaatattccacatctgctctcactctgccatggactcctggaccctctgctgtgtgtccctttgcatcctggtagcaaagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagc

SEQ ID NO: 188804 - DNA, 411 bp, Homo sapiens
  Payload ID: 17236
  Gene Symbol: TRBV12-5
  Gene Name: T cell receptor beta variable 12-5
  ENST ID: ENST00000621184
  CDS Start-End: 65-411
agctcctgtattcgtgcccacaagggcctcatctaggtgaaggctccacctgccccaccctgccatggccaccaggctcctctgctgtgtggttctttgtctcctgggagaagagcttatagatgctagagtcacccagacaccaaggcacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggt

SEQ ID NO: 188805 - DNA, 411 bp, Homo sapiens
  Payload ID: 17236
  Gene Symbol: TRBV12-5
  Gene Name: T cell receptor beta variable 12-5
  ENST ID: ENST00000632829
  CDS Start-End: 65-411
agctcctgtattcgtgcccacaagggcctcatctaggtgaaggctccacctgccccaccctgccatggccaccaggctcctctgctgtgtggttctttgtctcctgggagaagagcttatagatgctagagtcacccagacaccaagggacaaggtgacagagatgggacaagaagtaacaatgagatgtcagccaattttaggccacaatactgttttctggtacagacagaccatgatgcaaggactggagttgctggcttacttccgcaaccgggctcctctagatgattcggggatgccgaaggatcgattctcagcagagatgcctgatgcaactttagccactctgaagatccagccctcagaacccagggactcagctgtgtatttttgtgctagtggtttggt

SEQ ID NO: 188806 - DNA, 374 bp, Homo sapiens
  Payload ID: 17237
  Gene Symbol: TRBV13
  Gene Name: T cell receptor beta variable 13
  ENST ID: ENST00000614171
  CDS Start-End: 1-374
atgcttagtcctgacctgcctgactctgcctggaacaccaggctcctctgccgtgtcatgctttgtctcctgggagcaggttcagtggctgctggagtcatccagtccccaagacatctgatcaaagaaaagagggaaacagccactctgaaatgctatcctatccctagacacgacactgtctactggtaccagcagggtccaggtcaggacccccagttcctcatttcgttttatgaaaagatgcagagcgataaaggaagcatccctgatcgattctcagctcaacagttcagtgactatcattctgaactgaacatgagctccttggagctgggggactcagccctgtacttctgtgccagcagcttagg

SEQ ID NO: 188807 - DNA, 374 bp, Homo sapiens; identical to SEQ ID NO: 188806
  Payload ID: 17237
  Gene Symbol: TRBV13
  Gene Name: T cell receptor beta variable 13
  ENST ID: ENST00000633796
  CDS Start-End: 1-374

SEQ ID NO: 188808 - DNA, 406 bp, Homo sapiens
  Payload ID: 17238
  Gene Symbol: TRBV14
  Gene Name: T cell receptor beta variable 14
  ENST ID: ENST00000617639
  CDS Start-End: 60-406
cctttttctcatgcttgtaagctccttcatctggaaatgtgatttacctgggtcctgccatggtttccaggcttctcagtttagtgtccctttgtctcctgggagcaaagcacatagaagctggagttactcagttccccagccacagcgtaatagagaagggccagactgtgactctgagatgtgacccaatttctggacatgataatctttattggtatcgacgtgttatgggaaaagaaataaaatttctgttacattttgtgaaagagtctaaacaggatgagtccggtatgcccaacaatcgattcttagctgaaaggactggagggacgtattctactctgaaggtgcagcctgcagaactggaggattctggagtttatttctgtgccagcagccaaga

SEQ ID NO: 188809 - DNA, 406 bp, Homo sapiens; identical to SEQ ID NO: 188808
  Payload ID: 17238
  Gene Symbol: TRBV14
  Gene Name: T cell receptor beta variable 14
  ENST ID: ENST00000632432
  CDS Start-End: 60-406

SEQ ID NO: 188810 - DNA, 421 bp, Homo sapiens
  Payload ID: 17239
  Gene Symbol: TRBV15
  Gene Name: T cell receptor beta variable 15
  ENST ID: ENST00000616518
  CDS Start-End: 78-421
actcccacctctcaacccaggaatcagagcctgagacagacagatgcttcattcctgtatggggtggtattcctgccatgggtcctgggcttctccactggatggccctttgtctccttggaacaggtcatggggatgccatggtcatccagaacccaagataccaggttacccagtttggaaagccagtgaccctgagttgttctcagactttgaaccataacgtcatgtactggtaccagcagaagtcaagtcaggccccaaagctgctgttccactactatgacaaagattttaacaatgaagcagacacccctgataacttccaatccaggaggccgaacacttctttctgctttcttgacatccgctcaccaggcctgggggacgcagccatgtacctgtgtgccaccagcagaga

SEQ ID NO: 188811 - DNA, 421 bp, Homo sapiens; identical to SEQ ID NO: 188810
  Payload ID: 17239
  Gene Symbol: TRBV15
  Gene Name: T cell receptor beta variable 15
  ENST ID: ENST00000631835
  CDS Start-End: 78-421

SEQ ID NO: 188812 - DNA, 347 bp, Homo sapiens
  Payload ID: 17240
  Gene Symbol: TRBV16
  Gene Name: T cell receptor beta variable 16 (gene/pseudogene)
  ENST ID: ENST00000620773
  CDS Start-End: 1-347
atgagcccaatattcacctgcatcacaatcctttgtctgctggctgcaggttctcctggtgaagaagtcgcccagactccaaaacatcttgtcagaggggaaggacagaaagcaaaattatattgtgccccaataaaaggacacagttatgttttttggtaccaacaggtcctgaaaaacgagttcaagttcttgatttccttccagaatgaaaatgtctttgatgaaacaggtatgcccaaggaaagattttcagctaagtgcctcccaaattcaccctgtagccttgagatccaggctacgaagcttgaggattcagcagtgtatttttgtgccagcagccaatc

SEQ ID NO: 188813 - DNA, 347 bp, Homo sapiens; identical to SEQ ID NO: 188812
  Payload ID: 17240
  Gene Symbol: TRBV16
  Gene Name: T cell receptor beta variable 16 (gene/pseudogene)
  ENST ID: ENST00000633244
  CDS Start-End: 1-347

SEQ ID NO: 188814 - DNA, 344 bp, Homo sapiens
  Payload ID: 17241
  Gene Symbol: TRBV17
  Gene Name: T cell receptor beta variable 17 (non-functional)
  ENST ID: ENST00000619103
  CDS Start-End: 1-344
atggatatctggctcctctgctgggtgaccctgtgtctcttggcggcaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacactgaagatccatcccgcagagccgagggactcagccgtgtatctctacagtagcggtgg

SEQ ID NO: 188815 - DNA, 344 bp, Homo sapiens
  Payload ID: 17241
  Gene Symbol: TRBV17
  Gene Name: T cell receptor beta variable 17 (non-functional)
  ENST ID: ENST00000631663
  CDS Start-End: 1-344
atggatatctggctcctctgctgggtgaccctgtgtctcttggcggcaggacactcggagcctggagtcagccagacccccagacacaaggtcaccaacatgggacaggaggtgattctgaggtgcgatccatcttctggtcacatgtttgttcactggtaccgacagaatctgaggcaagaaatgaagttgctgatttccttccagtaccaaaacattgcagttgattcagggatgcccaaggaacgattcacagctgaaagacctaacggaacgtcttccacgctgaagatccatcccgcagagccgagggactcagccgtgtatctctacagtagcggtgg

SEQ ID NO: 188816 - DNA, 428 bp, Homo sapiens
  Payload ID: 17242
  Gene Symbol: TRBV18
  Gene Name: T cell receptor beta variable 18
  ENST ID: ENST00000611520
  CDS Start-End: 82-428
agctgtgaggtctggttccccgacgtgctgcagcaagtgcctttgccctgcctgtgggctccctccatggccaactctgctatggacaccagactactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacc

SEQ ID NO: 188817 - DNA, 428 bp, Homo sapiens
  Payload ID: 17242
  Gene Symbol: TRBV18
  Gene Name: T cell receptor beta variable 18
  ENST ID: ENST00000631559
  CDS Start-End: 82-428
agctgtgaggtctggttccccgacgtgctgcagcaagtgcctttgccctgcctgtgggctccctccatggccaactctgctatggacaccagagtactctgctgtgcggtcatctgtcttctgggggcaggtctctcaaatgccggcgtcatgcagaacccaagacacctggtcaggaggaggggacaggaggcaagactgagatgcagcccaatgaaaggacacagtcatgtttactggtatcggcagctcccagaggaaggtctgaaattcatggtttatctccagaaagaaaatatcatagatgagtcaggaatgccaaaggaacgattttctgctgaatttcccaaagagggccccagcatcctgaggatccagcaggtagtgcgaggagattcggcagcttatttctgtgccagctcaccacc

SEQ ID NO: 188818 - DNA, 552 bp, Homo sapiens
  Payload ID: 17243
  Gene Symbol: TRBV19
  Gene Name: T cell receptor beta variable 19
  ENST ID: ENST00000390393
  CDS Start-End: 209-552
ggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtctcctgggagcaaacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtataga

SEQ ID NO: 188819 - DNA, 552 bp, Homo sapiens
  Payload ID: 17243
  Gene Symbol: TRBV19
  Gene Name: T cell receptor beta variable 19
  ENST ID: ENST00000632638
  CDS Start-End: 209-552
ggaggtgcgaatgactctgctctctgtcctgtctcctcatctgcaaaattaggaagcctgtcttgattatctccaggaacctcccacctcttcattccagcctctgacaaactctgcacattaggccaggagaagcccccgagccaagtctcttttctcattctcttccaacaagtgcttggagctccaagaaggccccctttgcactatgagcaaccaggtgctctgctgtgtggtcctttgtttcctgggagcaaacaccgtggatggtggaatcactcagtccccaaagtacctgttcagaaaggaaggacagaatgtgaccctgagttgtgaacagaatttgaaccacgatgccatgtactggtaccgacaggacccagggcaagggctgagattgatctactactcacagatagtaaatgactttcagaaaggagatatagctgaagggtacagcgtctctcgggagaagaaggaatcctttcctctcactgtgacatcggcccaaaagaacccgacagctttctatctctgtgccagtagtataga

SEQ ID NO: 188820 - DNA, 421 bp, Homo sapiens
  Payload ID: 17244
  Gene Symbol: TRBV2
  Gene Name: T cell receptor beta variable 2
  ENST ID: ENST00000455382
  CDS Start-End: 75-421
aaaatgcccctcctttcctccacaggaccagatgcctgagctaggaaaggcctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcgctgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgaagc

SEQ ID NO: 188821 - DNA, 421 bp, Homo sapiens
  Payload ID: 17244
  Gene Symbol: TRBV2
  Gene Name: T cell receptor beta variable 2
  ENST ID: ENST00000632828
  CDS Start-End: 75-421
aaaatgcccctcctttcctccacaggaccagatgcctgagctaggaaaggcctcattcctgctgtgatcctgccatggatacctggctcgtatgctgggcaatttttagtctcttgaaagcaggactcacagaacctgaagtcacccagactcccagccatcaggtcacacagatgggacaggaagtgatcttgcactgtgtccccatctctaatcacttatacttctattggtacagacaaatcttggggcagaaagtcgagtttctggtttccttttataataatgaaatctcagagaagtctgaaatattcgatgatcaattctcagttgaaaggcctgatggatcaaatttcactctgaagatccggtccacaaagctggaggactcagccatgtacttctgtgccagcagtgaagc

SEQ ID NO: 188822 - DNA, 416 bp, Homo sapiens
  Payload ID: 17245
  Gene Symbol: TRBV20OR9-2
  Gene Name: T cell receptor beta variable 20/OR9-2 (non-functional)
  ENST ID: ENST00000379435
  CDS Start-End: 27-416
gatcagtcatccctcctcgctggtgaatggagacagtggtcacaactctccccagagaaggtggtgtggggccatcacggaagatgctgctgcttctgctgcttctggggccaggctccgggcttagtgctgtcgtctctcaacatccgagcagggttatctgtaagagtggaacctctgtgaacatcgagtgccgttccctggactttcaggccacaactatgttttggtatcgtcagctccggaaacagagcctcatgctgatggcaacttccaatgagggctccgaggtcacatacgagcaaggcgtcaagaaggacaagtttcccatcaaccatccaaacctgaccttctccgctctgacagtgaccagtgcccatcctgaagacagcagcttctacatctgcagtgctaga

SEQ ID NO: 188823 - DNA, 413 bp, Homo sapiens
  Payload ID: 17246
  Gene Symbol: TRBV20-1
  Gene Name: T cell receptor beta variable 20-1
  ENST ID: ENST00000390394
  CDS Start-End: 79-413
gtcatccctcctcgctggtgaatggaggcagtggtcacaactctccccagagaaggtggtgtgaggccatcacggaagatgctgctgcttctgctgcttctggggccaggctccgggcttggtgctgtcgtctctcaacatccgagcagggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagaga

SEQ ID NO: 188824 - DNA, 413 bp, Homo sapiens
  Payload ID: 17246
  Gene Symbol: TRBV20-1
  Gene Name: T cell receptor beta variable 20-1
  ENST ID: ENST00000633466
  CDS Start-End: 79-413
gtcatccctcctcgctggtgaatggaggcagtggtcacaactctccccagagaaggtggtgtgaggccatcacggaagatgctgctgcttctgctgcttctggggccaggctccgggcttggtgctgtcgtctctcaacatccgagctgggttatctgtaagagtggaacctctgtgaagatcgagtgccgttccctggactttcaggccacaactatgttttggtatcgtcagttcccgaaacagagtctcatgctgatggcaacttccaatgagggctccaaggccacatacgagcaaggcgtcgagaaggacaagtttctcatcaaccatgcaagcctgaccttgtccactctgacagtgaccagtgcccatcctgaagacagcagcttctacatctgcagtgctagaga

SEQ ID NO: 188825 - DNA, 367 bp, Homo sapiens
  Payload ID: 17247
  Gene Symbol: TRBV21OR9-2
  Gene Name: T cell receptor beta variable 21/OR9-2 (pseudogene)
  ENST ID: ENST00000331828
  CDS Start-End: 1-367
acgatttctgtctgagccaaccaggtgcctcagacttctctgctgtgtggccctttctttctggggagcagcctccatggacaccaaggtcacccagagacctagatttctggtcaaagcaaatgaacagaaagcaaagatggactgtgttcctataaaaagacatagttatgtttactggtatcataagacgctggaagaagagctcaagttttttatttactttcagaatgaagaaattattcagaaagcagaaataatcaatgagcgattttcagcccaatgcccccaaaactcaccctgtaccttggagatccagtccacggagtcaggagacacagcacggtatttctgtgccaacagcaaa

SEQ ID NO: 188826 - DNA, 335 bp, Homo sapiens
  Payload ID: 17248
  Gene Symbol: TRBV23OR9-2
  Gene Name: T cell receptor beta variable 23/OR9-2 (non-functional)
  ENST ID: ENST00000390389
  CDS Start-End: 1-335
ccacgggcaccaggcttctcggctgggtagctctttgtctcctggcagcaggctgttttcatgccaaagtcacacagactccaggatatttggtcaaaggaaaaggaaggaaaacaaagatgtattgtacccccaaaaacggacatacttttgtttgttggtatcagcagaatcagaataaagagtttatgtttttgatttcctttcagaatgaacaagttcttcaagaaatggagatgcacaagaagcgattctcatctcaatgccccaagaacccaccctgcagcctggcaatcctgtcctcggaaccgggagacaccgcactgtatctctgt

SEQ ID NO: 188827 - DNA, 347 bp, Homo sapiens
  Payload ID: 17249
  Gene Symbol: TRBV23-1
  Gene Name: T cell receptor beta variable 23-1 (non-functional)
  ENST ID: ENST00000390396
  CDS Start-End: 1-347
atgggcaccaggctcctcggctgtgcagccctgtgtctcctggcagcagactcttttcatgccaaagtcacacagactccaggacatttggtcaaaggaaaaggacagaaaacaaagatggattgtacccccgaaaaaggacatacttttgtttattggtatcaacagaatcagaataaagagtttatgcttttgatttcctttcagaatgaacaagttcttcaagaaacggagatgcacaagaagcgattctcatctcaatgccccaagaacgcaccctgcagcctggcaatcctgtcctcagaaccgggagacacggcactgtatctctgcgccagcagtcaatc

SEQ ID NO: 188828 - DNA, 347 bp, Homo sapiens; identical to SEQ ID NO: 188827
  Payload ID: 17249
  Gene Symbol: TRBV23-1
  Gene Name: T cell receptor beta variable 23-1 (non-functional)
  ENST ID: ENST00000633842
  CDS Start-End: 1-347

SEQ ID NO: 188829 - DNA, 381 bp, Homo sapiens
  Payload ID: 17250
  Gene Symbol: TRBV24-1
  Gene Name: T cell receptor beta variable 24-1
  ENST ID: ENST00000390397
  CDS Start-End: 37-381
agagctggaaacacctccatcctgcctcttcatgccatggcctccctgctcttcttctgtggggccttttatctcctgggaacagggtccatggatgctgatgttacccagaccccaaggaataggatcacaaagacaggaaagaggattatgctggaatgttctcagactaagggtcatgatagaatgtactggtatcgacaagacccaggactgggcctacagttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttg

SEQ ID NO: 188830 - DNA, 381 bp, Homo sapiens
  Payload ID: 17250
  Gene Symbol: TRBV24-1
  Gene Name: T cell receptor beta variable 24-1
  ENST ID: ENST00000633092
  CDS Start-End: 37-381
agagctggaaacacctccatcctgcctcttcatgccatggcctccctgctcttcttctgtggggccttttatctcctgggaacagggtccatggatgctgatgttacccagaccccaaggaataggatcacaaagacaggaaagaggattatgctggaatgttctcagactaagggtcatgatagaatgtactggtatcgacaagacccaggactgggcctacggttgatctattactcctttgatgtcaaagatataaacaaaggagagatctctgatggatacagtgtctctcgacaggcacaggctaaattctccctgtccctagagtctgccatccccaaccagacagctctttacttctgtgccaccagtgatttg

SEQ ID NO: 188831 - DNA, 381 bp, Homo sapiens
  Payload ID: 17251
  Gene Symbol: TRBV25-1
  Gene Name: T cell receptor beta variable 25-1
  ENST ID: ENST00000390398
  CDS Start-End: 38-381
actactgggagacatcctctctagccccaactgtgccatgactatcaggctcctctgctacgtgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaata

SEQ ID NO: 188832 - DNA, 381 bp, Homo sapiens
  Payload ID: 17251
  Gene Symbol: TRBV25-1
  Gene Name: T cell receptor beta variable 25-1
  ENST ID: ENST00000610439
  CDS Start-End: 38-381
actactgggagacatcctctctagccccaactgtgccatgactatcaggctcctctgctacatgggcttttattttctgggggcaggcctcatggaagctgacatctaccagaccccaagataccttgttatagggacaggaaagaagatcactctggaatgttctcaaaccatgggccatgacaaaatgtactggtatcaacaagatccaggaatggaactacacctcatccactattcctatggagttaattccacagagaagggagatctttcctctgagtcaacagtctccagaataaggacggagcattttcccctgaccctggagtctgccaggccctcacatacctctcagtacctctgtgccagcagtgaata

SEQ ID NO: 188833 - DNA, 387 bp, Homo sapiens
  Payload ID: 17252
  Gene Symbol: TRBV27
  Gene Name: T cell receptor beta variable 27
  ENST ID: ENST00000390399
  CDS Start-End: 44-387
acctggagcccccagaactggcagacacctgcctgatgctgccatgggcccccagctccttggctatgtggtcctttgccttctaggagcaggccccctggaagcccaagtgacccagaacccaagatacctcatcacagtgactggaaagaagttaacagtgacttgttctcagaatatgaaccatgagtatatgtcctggtatcgacaagacccagggctgggcttaaggcagatctactattcaatgaatgttgaggtgactgataagggagatgttcctgaagggtacaaagtctctcgaaaagagaagaggaatttccccctgatcctggagtcgcccagccccaaccagacctctctgtacttctgtgccagcagtttatc

SEQ ID NO: 188834 - DNA, 387 bp, Homo sapiens; identical to SEQ ID NO: 188833
  Payload ID: 17252
  Gene Symbol: TRBV27
  Gene Name: T cell receptor beta variable 27
  ENST ID: ENST00000633283
  CDS Start-End: 44-387

SEQ ID NO: 188835 - DNA, 364 bp, Homo sapiens
  Payload ID: 17253
  Gene Symbol: TRBV28
  Gene Name: T cell receptor beta variable 28
  ENST ID: ENST00000390400
  CDS Start-End: 21-364
attctttcttcaaagcagccatgggaatcaggctcctctgtcgtgtggccttttgtttcctggctgtaggcctcgtagatgtgaaagtaacccagagctcgagatatctagtcaaaaggacgggagagaaagtttttctggaatgtgtccaggatatggaccatgaaaatatgttctggtatcgacaagacccaggtctggggctacggctgatctatttctcatatgatgttaaaatgaaagaaaaaggagatattcctgaggggtacagtgtctctagagagaagaaggagcgcttctccctgattctggagtccgccagcaccaaccagacatctatgtacctctgtgccagcagtttatg

SEQ ID NO: 188836 - DNA, 364 bp, Homo sapiens; identical to SEQ ID NO: 188835
  Payload ID: 17253
  Gene Symbol: TRBV28
  Gene Name: T cell receptor beta variable 28
  ENST ID: ENST00000619125
  CDS Start-End: 21-364

SEQ ID NO: 188837 - DNA, 402 bp, Homo sapiens
  Payload ID: 17254
  Gene Symbol: TRBV29-1
  Gene Name: T cell receptor beta variable 29-1
  ENST ID: ENST00000422143
  CDS Start-End: 68-402
gaaggaaagatgaacttgagtttcacttcttagtgccttttctcaggggagaggccatcacttgaagatgctgagtcttctgctccttctcctgggactaggctctgtgttcagtgctgtcatctctcaaaagccaagcagggatatctgtcaacgtggaacctccctgacgatccagtgtcaagtcgatagccaagtcaccatgatgttctggtaccgtcagcaacctggacagagcctgacactgatcgcaactgcaaatcagggctctgaggccacatatgagagtggatttgtcattgacaagtttcccatcagccgcccaaacctaacattctcaactctgactgtgagcaacatgagccctgaagacagcagcatatatctctgcagcgttgaaga

SEQ ID NO: 188838 - DNA, 402 bp, Homo sapiens; identical to SEQ ID NO: 188837
  Payload ID: 17254
  Gene Symbol: TRBV29-1
  Gene Name: T cell receptor beta variable 29-1
  ENST ID: ENST00000634198
  CDS Start-End: 68-402

SEQ ID NO: 188839 - DNA, 447 bp, Homo sapiens
  Payload ID: 17255
  Gene Symbol: TRBV30
  Gene Name: T cell receptor beta variable 30 (gene/pseudogene)
  ENST ID: ENST00000417977
  CDS Start-End: 113-447
ttcctctgctctggcagcagatctcccagagggagcagcctgaccacatcactggcccagaagaggaggcgtctgtcccccagactagctgaaggaaaggctggcttggatgatgctctgctctctccttgcccttctcctgggcactttctttggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctccttctcagtgactctggcttctatctctgtgcctggagtgt

SEQ ID NO: 188840 - DNA, 447 bp, Homo sapiens
  Payload ID: 17255
  Gene Symbol: TRBV30
  Gene Name: T cell receptor beta variable 30 (gene/pseudogene)
  ENST ID: ENST00000631690
  CDS Start-End: 113-447
ttcctctgctctggcagcagatctcccagagggagcagcctgaccacatcactggcccagaagaggaggcgtctgtcccccagactagctgaaggaaaggctggcttggatgatgctctgctctctccttgcccttctcctgggcactttctttggggtcagatctcagactattcatcaatggccagcgaccctggtgcagcctgtgggcagcccgctctctctggagtgcactgtggagggaacatcaaaccccaacctatactggtaccgacaggctgcaggcaggggcctccagctgctcttctactccgttggtattggccagatcagctctgaggtgccccagaatctctcagcctccagaccccaggaccggcagttcatcctgagttctaagaagctcctcctcagtgactctggcttctatctctgtgcctggagtgt

SEQ ID NO: 188841 - DNA, 391 bp, Homo sapiens
  Payload ID: 17256
  Gene Symbol: TRBV3-1
  Gene Name: T cell receptor beta variable 3-1
  ENST ID: ENST00000390387
  CDS Start-End: 48-391
agaccagaatcctgccctgggccttgcctggtctgcctcactctgccatgggctgcaggctcctctgctgtgtggtcttctgcctcctccaagcaggtcccttggacacagctgtttcccagactccaaaatacctggtcacacagatgggaaacgacaagtccattaaatgtgaacaaaatctgggccatgatactatgtattggtataaacaggactctaagaaatttctgaagataatgtttagctacaataataaggagctcattataaatgaaacagttccaaatcgcttctcacctaaatctccagacaaagctcacttaaatcttcacatcaattccctggagcttggtgactctgctgtgtatttctgtgccagcagccaaga

SEQ ID NO: 188842 - DNA, 391 bp, Homo sapiens; identical to SEQ ID NO: 188841
  Payload ID: 17256
  Gene Symbol: TRBV3-1
  Gene Name: T cell receptor beta variable 3-1
  ENST ID: ENST00000632422
  CDS Start-End: 48-391

SEQ ID NO: 188843 - DNA, 373 bp, Homo sapiens
  Payload ID: 17257
  Gene Symbol: TRBV4-1
  Gene Name: T cell receptor beta variable 4-1
  ENST ID: ENST00000390357
  CDS Start-End: 30-373
agaggccccatctcagacccgaggctagcatgggctgcaggctgctctgctgtgcggttctctgtctcctgggagcagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgccaagtcgcttctcacctgaatgccccaacagctctctcttaaaccttcacctacacgccctgcagccagaagactcagccctgtatctctgcgccagcagccaaga

SEQ ID NO: 188844 - DNA, 373 bp, Homo sapiens
  Payload ID: 17257
  Gene Symbol: TRBV4-1
  Gene Name: T cell receptor beta variable 4-1
  ENST ID: ENST00000632713
  CDS Start-End: 30-373
agaggccccatctcagacccgaggctagcatgggctgcaggctgctctgctgtgcggttctctgtctcctgggagcagttcccatagacactgaagttacccagacaccaaaacacctggtcatgggaatgacaaataagaagtctttgaaatgtgaacaacatatggggcacagggctatgtattggtacaagcagaaagctaagaagccaccggagctcatgtttgtctacagctatgagaaactctctataaatgaaagtgtgcgaagtcgcttctcacctgaatgccccaacagctctctcttaaaccttcacctacacgccctgcagccagaagactcagccctgtatctctgcgccagcagccaaga

SEQ ID NO: 188845 - DNA, 455 bp, Homo sapiens
  Payload ID: 17258
  Gene Symbol: TRBV4-2
  Gene Name: T cell receptor beta variable 4-2
  ENST ID: ENST00000390392
  CDS Start-End: 112-455
aggagcagtgacatcacaggaaaaaccaccaaccaaggccaaggagaccagagcccagcacctcacccagaggaccccagtcagaggccccatctcagacccgaggctagcatgggctgcaggctgctctgctgtgcggttctctgtctcctgggagcggtccccatggaaacgggagttacgcagacaccaagacacctggtcatgggaatgacaaataagaagtctttgaaatgtgaacaacatctggggcataacgctatgtattggtacaagcaaagtgctaagaagccactggagctcatgtttgtctacaactttaaagaacagactgaaaacaacagtgtgccaagtcgcttctcacctgaatgccccaacagctctcacttattccttcacctacacaccctgcagccagaagactcggccctgtatctctgtgccagcagccaaga

SEQ ID NO: 188846 - DNA, 455 bp, Homo sapiens; identical to SEQ ID NO: 188845
  Payload ID: 17258
  Gene Symbol: TRBV4-2
  Gene Name: T cell receptor beta variable 4-2
  ENST ID: ENST00000632512
  CDS Start-End: 112-455

SEQ ID NO: 188847 - DNA, 455 bp, Homo sapiens
  Payload ID: 17259
  Gene Symbol: TRBV4-3
  Gene Name: T cell receptor beta variable 4-3
  ENST ID: ENST00000631427
  CDS Start-End: 112-455
aggagcagtgacatcacaggaaaaaccaccaaccaaggccaaggagaccagagcccagcacctcacccagaggaccccagtcagaggccccatctcagacccgaggctagcatgggctgcaggctgctctgctgtgcggttctctgtctcctgggagcggtccccatggaaacgggagttacgcagacaccaagacacctggtcatgggaatgacaaataagaagtctttgaaatgtgaacaacatctgggtcataacgctatgtattggtacaagcaaagtgctaagaagccactggagctcatgtttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagccaaga

SEQ ID NO: 188848 - DNA, 652 bp, Homo sapiens
  Payload ID: 17260
  Gene Symbol: TRBV5-1
  Gene Name: T cell receptor beta variable 5-1
  ENST ID: ENST00000390381
  CDS Start-End: 310-652
ctcagaggaccagtatccctcacagggtgacacctgaccagctctgtcccacctggccatgggctccaggtacctctgatgggaagacctttgtctcttgggaacaagtgaatccttggcacaggcccagtggattctgctgtgcagaacagagagcagtggacctcaggaggcctgcaaggggaggacataggacagtgacatcacagtatgcccctcccaccaggaaaagcaaggctgagaatttagctctttcccaggaggaccaagccctgagcacagacacagtgctgcctgcccctttgtgccatgggctccaggctgctctgttgggtgctgctttgtctcctgggagcaggcccagtaaaggctggagtcactcaaactccaagatatctgatcaaaacgagaggacagcaagtgacactgagctgctcccctatctctgggcataggagtgtatcctggtaccaacagaccccaggacagggccttcagttcctctttgaatacttcagtgagacacagagaaacaaaggaaacttccctggtcgattctcagggcgccagttctctaactctcgctctgagatgaatgtgagcaccttggagctgggggactcggccctttatctttgcgccagcagcttgg

SEQ ID NO: 188849 - DNA, 652 bp, Homo sapiens; identical to SEQ ID NO: 188848
  Payload ID: 17260
  Gene Symbol: TRBV5-1
  Gene Name: T cell receptor beta variable 5-1
  ENST ID: ENST00000633384
  CDS Start-End: 310-652

SEQ ID NO: 188850 - DNA, 343 bp, Homo sapiens
  Payload ID: 17261
  Gene Symbol: TRBV5-3
  Gene Name: T cell receptor beta variable 5-3 (non-functional)
  ENST ID: ENST00000390362
  CDS Start-End: 1-343
atgggccctgggctcctctgctgggaactgctttatctcctgggagcaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactattgctctgagatgaatgtgagtgccttggagctgggggactcggccctgtatctctgtgccagaagcttgg

SEQ ID NO: 188851 - DNA, 343 bp, Homo sapiens
  Payload ID: 17261
  Gene Symbol: TRBV5-3
  Gene Name: T cell receptor beta variable 5-3 (non-functional)
  ENST ID: ENST00000634123
  CDS Start-End: 1-343
atgggccccgggctcctctgctgggaactgctttatctcctgggagcaggcccagtggaggctggagtcacccaaagtcccacacacctgatcaaaacgagaggacagcaagtgactctgagatgctctcctatctctgggcacagcagtgtgtcctggtaccaacaggccccgggtcaggggccccagtttatctttgaatatgctaatgagttaaggagatcagaaggaaacttccctaatcgattctcagggcgccagttccatgactgttgctctgagatgaatgtgagtgccttggagctgggggactcggccctgtatctctgtgccagaagcttgg

SEQ ID NO: 188852 - DNA, 544 bp, Homo sapiens
  Payload ID: 17262
  Gene Symbol: TRBV5-4
  Gene Name: T cell receptor beta variable 5-4
  ENST ID: ENST00000454561
  CDS Start-End: 202-544
ttcagctctgcaggacaggtagagactccaggatcatccactgagcactggacataaggaaggctgcatggggaggacacaggacagtgacatcacaggatacccctcctattaggaaaatcaaggcccagaattcactcggctcttccccaggaggaccaagccctgaatcaggtgcagtgctgcctgccccactgtgccatgggccctgggctcctctgctgggcgctgctttgtctcctgggagcaggctcagtggagactggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaattatagctctgagctgaatgtgaacgccttggagctggacgactcggccctgtatctctgtgccagcagcttgg

SEQ ID NO: 188853 - DNA, 544 bp, Homo sapiens
  Payload ID: 17262
  Gene Symbol: TRBV5-4
  Gene Name: T cell receptor beta variable 5-4
  ENST ID: ENST00000633696
  CDS Start-End: 202-544
ttcagctctgcaggacaggtagagactccaggatcatccactgagcactggacataaggaaggctgcatggggaggactcaggacagtgacatcacaggatacccctcctattaggaaaatcaaggcccagaattcactcggctcttccccaggaggaccaagccctgaatcaggtgcagtgctgcctggcccactgtgccatgggccctgggctcctctgctgggcgctgctttgtctcctgggagcaggctcagtggacgctggagtcacccaaagtcccacacacctgatcaaaacgagaggacagcaagtgactctgagatgctcttctcagtctgggcacaacactgtgtcctggtaccaacaggccctgggtcaggggccccagtttatctttcagtattatagggaggaagagaatggcagaggaaacttccctcctagattctcaggtctccagttccctaatgatagctctgagctgaatgtgaatgccttggagctggacgactcggccctgtatctctgtgccagcagcttgg

SEQ ID NO: 188854 - DNA, 350 bp, Homo sapiens
  Payload ID: 17263
  Gene Symbol: TRBV5-5
  Gene Name: T cell receptor beta variable 5-5
  ENST ID: ENST00000390372
  CDS Start-End: 8-350
ctgtgccatgggccctgggctcctctgctgggtgctgctttgtctcctgggagcaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagcttgg

SEQ ID NO: 188855 - DNA, 350 bp, Homo sapiens
  Payload ID: 17263
  Gene Symbol: TRBV5-5
  Gene Name: T cell receptor beta variable 5-5
  ENST ID: ENST00000632187
  CDS Start-End: 8-350
ctgtgccatgggccctgggctcctctgctgggtgctgctttgtctcctggtagcaggcccagtggacgctggagtcacccaaagtcccacacacctgatcaaaacgagaggacagcaagtgactctgagatgctctcctatctctgggcacaagagtgtgtcctggtaccaacaggtcctgggtcaggggccccagtttatctttcagtattatgagaaagaagagagaggaagaggaaacttccctgatcgattctcagctcgccagttccctaactatagctctgagctgaatgtgaacgccttgttgctgggggactcggccctgtatctctgtgccagcagcttgg

SEQ ID NO: 188856 - DNA, 384 bp, Homo sapiens
  Payload ID: 17264
  Gene Symbol: TRBV5-6
  Gene Name: T cell receptor beta variable 5-6
  ENST ID: ENST00000390375
  CDS Start-End: 42-384
aagccctgaatcagatgcagtgcttcctgtccctctgtgccatgggccccgggctcctctgctgggcactgctttgtctcctgggagcaggcttagtggacgctggagtcacccaaagtcccacacacctgatcaaaacgagaggacagcaagtgactctgagatgctctcctaagtctgggcatgacactgtgtcctggtaccaacaggccctgggtcaggggccccagtttatctttcagtattatgaggaggaagagagacagagaggcaacttccctgatcgattctcaggtcaccagttccctaactatagctctgagctgaatgtgaacgccttgttgctgggggactcggccctctatctctgtgccagcagcttgg

SEQ ID NO: 188857 - DNA, 384 bp, Homo sapiens; identical to SEQ ID NO: 188856
  Payload ID: 17264
  Gene Symbol: TRBV5-6
  Gene Name: T cell receptor beta variable 5-6
  ENST ID: ENST00000632216
  CDS Start-End: 42-384

SEQ ID NO: 188858 - DNA, 343 bp, Homo sapiens
  Payload ID: 17265
  Gene Symbol: TRBV5-7
  Gene Name: T cell receptor beta variable 5-7 (non-functional)
  ENST ID: ENST00000390378
  CDS Start-End: 1-343
atgggccccgggctcctctgctgggtgctgctttgtcccctaggagaaggcccagtggacgctggagtcacccaaagtcccacacacctgatcaaaacgagaggacagcacgtgactctgagatgctctcctatctctgggcacaccagtgtgtcctcgtaccaacaggccctgggtcaggggccccagtttatctttcagtattatgagaaagaagagagaggaagaggaaacttccctgatcaattctcaggtcaccagttccctaactatagctctgagctgaatgtgaacgccttgttgctaggggactcggccctctatctctgtgccagcagcttgg

SEQ ID NO: 188859 - DNA, 343 bp, Homo sapiens; identical to SEQ ID NO: 188858
  Payload ID: 17265
  Gene Symbol: TRBV5-7
  Gene Name: T cell receptor beta variable 5-7 (non-functional)
  ENST ID: ENST00000633790
  CDS Start-End: 1-343

SEQ ID NO: 188860 - DNA, 478 bp, Homo sapiens
  Payload ID: 17266
  Gene Symbol: TRBV5-8
  Gene Name: T cell receptor beta variable 5-8
  ENST ID: ENST00000631639
  CDS Start-End: 136-478
tggccactgaggaaagggaagagaatgttgcctgggacaggaaaatatagaaaatgaaggcccagaactcactcggctcttccccaggaagaccaagccctgaatcaggtgcagtgccgcctggcccactgtgccatgggacccaggctcctcttctgggcactgctttgtctcctcggaacaggcccagtggaggctggagtcacacaaagtcccacacacctgatcaaaacgagaggacagcaagcgactctgagatgctctcctatctctgggcacaccagtgtgtactggtaccaacaggccctgggtctgggcctccagttcctcctttggtatgacgagggtgaagagagaaacagaggaaacttccctcctagattttcaggtcgccagttccctaattatagctctgagctgaatgtgaacgccttggagctggaggactcggccctgtatctctgtgccagcagcttgg

SEQ ID NO: 188861 - DNA, 401 bp, Homo sapiens
  Payload ID: 17267
  Gene Symbol: TRBV6-1
  Gene Name: T cell receptor beta variable 6-1
  ENST ID: ENST00000390353
  CDS Start-End: 58-401
gttcccctatcaccgatgcacagacccagaagacccctccatcctgtagcacctgccatgagcatcgggctcctgtgctgtgtggccttttctctcctgtgggcaagtccagtgaatgctggtgtcactcagaccccaaaattccaggtcctgaagacaggacagagcatgacactgcagtgtgcccaggatatgaaccataactccatgtactggtatcgacaagacccaggcatgggactgaggctgatttattactcagcttctgagggtaccactgacaaaggagaagtccccaatggctacaatgtctccagattaaacaaacgggagttctcgctcaggctggagtcggctgctccctcccagacatctgtgtacttctgtgccagcagtgaagc

SEQ ID NO: 188862 - DNA, 401 bp, Homo sapiens; identical to SEQ ID NO: 188861
  Payload ID: 17267
  Gene Symbol: TRBV6-1
  Gene Name: T cell receptor beta variable 6-1
  ENST ID: ENST00000631557
  CDS Start-End: 58-401

SEQ ID NO: 188863 - DNA, 392 bp, Homo sapiens
  Payload ID: 17268
  Gene Symbol: TRBV6-2
  Gene Name: T cell receptor beta variable 6-2 (gene/pseudogene)
  ENST ID: ENST00000632016
  CDS Start-End: 49-392
tcaccaatgcacagacccagaggacccctccatcctgcagttcctgccatgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactc

SEQ ID NO: 188864 - DNA, 424 bp, Homo sapiens
  Payload ID: 17268
  Gene Symbol: TRBV6-2
  Gene Name: T cell receptor beta variable 6-2 (gene/pseudogene)
  ENST ID: ENST00000634383
  CDS Start-End: 81-424
agaatgacgcccttgaaagacgtgttcccttttcaccaatgcacagacccagaggacccctccatcctgcagttcctgccatgagcctcgggctcctgtgctgtggggccttttctctcctgtgggcaggtccagtgaatgctggtgtcactcagaccccaaaattccgggtcctgaagacaggacagagcatgacactgctgtgtgcccaggatatgaaccatgaatacatgtactggtatcgacaagacccaggcatggggctgaggctgattcattactcagttggtgagggtacaactgccaaaggagaggtccctgatggctacaatgtctccagattaaaaaaacagaatttcctgctggggttggagtcggctgctccctcccaaacatctgtgtacttctgtgccagcagttactc

SEQ ID NO: 188865 - DNA, 424 bp, Homo sapiens; identical to SEQ ID NO: 188864
  Payload ID: 17269
  Gene Symbol: TRBV6-3
  Gene Name: T cell receptor beta variable 6-3
  ENST ID: ENST00000632148
  CDS Start-End: 81-424

SEQ ID NO: 188866 - DNA, 365 bp, Homo sapiens
  Payload ID: 17270
  Gene Symbol: TRBV6-4
  Gene Name: T cell receptor beta variable 6-4
  ENST ID: ENST00000390360
  CDS Start-End: 22-365
ctctgtcttgtagcatctgccatgagcatcaggctcctgtgctgtgtggccttttctctcctgtgggcaggtccagtgactgctgggatcacccaggcaccaacatctcagatcctggcagcaggacggagcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgactc

SEQ ID NO: 188867 - DNA, 365 bp, Homo sapiens
  Payload ID: 17270
  Gene Symbol: TRBV6-4
  Gene Name: T cell receptor beta variable 6-4
  ENST ID: ENST00000633472
  CDS Start-End: 22-365
ctctgtcttgtagcatctgccatgagaatcaggctcctgtgctgtgtggccttttctctcctgtgggcaggtccagtgattgctgggatcacccaggcaccaacatctcagatcctggcagcaggacggcgcatgacactgagatgtacccaggatatgagacataatgccatgtactggtatagacaagatctaggactggggctaaggctcatccattattcaaatactgcaggtaccactggcaaaggagaagtccctgatggttatagtgtctccagagcaaacacagatgatttccccctcacgttggcgtctgctgtaccctctcagacatctgtgtacttctgtgccagcagtgactc

SEQ ID NO: 188868 - DNA, 410 bp, Homo sapiens
  Payload ID: 17271
  Gene Symbol: TRBV6-5
  Gene Name: T cell receptor beta variable 6-5
  ENST ID: ENST00000390368
  CDS Start-End: 67-410
gagagtcctgctcccctttcatcaatgcacagatacagaagacccctccgtcatgcagcatctgccatgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactc

SEQ ID NO: 188869 - DNA, 432 bp, Homo sapiens
  Payload ID: 17271
  Gene Symbol: TRBV6-5
  Gene Name: T cell receptor beta variable 6-5
  ENST ID: ENST00000616186
  CDS Start-End: 58-432
gttcccttttcaccaatgcacagacccagaggacccctccatcctgcagttcctgccatgagcctcgggctcctgtgctgtggggccttttctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcttactccacagcgctacaaggcccactgtgacatcggcc

SEQ ID NO: 188870 - DNA, 410 bp, Homo sapiens; identical to SEQ ID NO: 188868
  Payload ID: 17271
  Gene Symbol: TRBV6-5
  Gene Name: T cell receptor beta variable 6-5
  ENST ID: ENST00000633072
  CDS Start-End: 67-410

SEQ ID NO: 188871 - DNA, 388 bp, Homo sapiens
  Payload ID: 17272
  Gene Symbol: TRBV6-6
  Gene Name: T cell receptor beta variable 6-6
  ENST ID: ENST00000390371
  CDS Start-End: 45-388
caatgcacagatacagaagacccctccgtcctggagcacctgccatgagcatcagcctcctgtgctgtgcagcctttcctctcctgtgggcaggtccagtgaatgctggtgtcactcagaccccaaaattccgcatcctgaagataggacagagcatgacactgcagtgtgcccaggatatgaaccataactacatgtactggtatcgacaagacccaggcatggggctgaagctgatttattattcagttggtgctggtatcactgacaaaggagaagtcccgaatggctacaacgtctccagatcaaccacagaggatttcccgctcaggctggagttggctgctccctcccagacatctgtgtacttctgtgccagcagttactc

SEQ ID NO: 188872 - DNA, 390 bp, Homo sapiens
  Payload ID: 17272
  Gene Symbol: TRBV6-6
  Gene Name: T cell receptor beta variable 6-6
  ENST ID: ENST00000633963
  CDS Start-End: 47-390
atcaatgcacagatacagaagacccctccgtcctggagcacctgccatgagcatcagcctcctgtgctgtgcagcctttcctctcctgtgggcaggtccagtgaatgctggtgtcactcagaccccaaaattccgcatcctgaagataggacagagcatgacactgcagtgtgcccaggatatgaaccataactacatgtactggtatcgacaagacccaggcatggggctgaagctgatttattattcagttggtgctggtatcactgataaaggagaagtcccgaatggctacaacgtctccagatcaaccacagagtatttcccgctcaggctggagttggctgctccctcccagacatctgtgtacttctgtgccagcagttactc

SEQ ID NO: 188873 - DNA, 344 bp, Homo sapiens
  Payload ID: 17273
  Gene Symbol: TRBV6-7
  Gene Name: T cell receptor beta variable 6-7 (non-functional)
  ENST ID: ENST00000390373
  CDS Start-End: 1-344
atgagcctcgggctcctgtgctgtgtggccttttctctcctgtgggcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggctgatttactactcagttgctgctgctctcactgacaaaggagaagttcccaatggctacaatgtctccagatcaaacacagaggatttccccctcaagctggagtcagctgctccctctcagacttctgtttacttctgtgccagcagttactc

SEQ ID NO: 188874 - DNA, 386 bp, Homo sapiens
  Payload ID: 17273
  Gene Symbol: TRBV6-7
  Gene Name: T cell receptor beta variable 6-7 (non-functional)
  ENST ID: ENST00000631511
  CDS Start-End: 43-386
atgcacagacccagaagacccctccgtcctgcagcccctgccatgagcctcgggctcctgtgctgtgtggccttttctctcctgtgggcaggtccaatgaatgctggtgtcactcagaccccaaaattccacgtcctgaagacaggacagagcatgactctgctgtgtgcccaggatatgaaccatgaatacatgtatcggtatcgacaagacccaggcaaggggctgaggcttatttactactcagttgctgctgctctcactgacaaaggagaagttcccaatggctacaatgtctccagatcaaacacagaggatttccccctcaagctggagtcagctgctccctctcagacttctgtttacttctgtgccagcagttactc

SEQ ID NO: 188875 - DNA, 341 bp, Homo sapiens
  Payload ID: 17274
  Gene Symbol: TRBV6-8
  Gene Name: T cell receptor beta variable 6-8
  ENST ID: ENST00000390376
  CDS Start-End: 1-341
atgagcctcgggctcctgtgctgtgcggccttttctctcctgtgggcaggtcccgtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccagacatctgtgtacttgtgtgccagcagttactc

SEQ ID NO: 188876 - DNA, 407 bp, Homo sapiens
  Payload ID: 17274
  Gene Symbol: TRBV6-8
  Gene Name: T cell receptor beta variable 6-8
  ENST ID: ENST00000632425
  CDS Start-End: 67-407
gagagtcctgttccccttttatcaatgcacagacccagaagacccctccgtcctgcagcccctgccatgagcctcgggctcctgtgctgtgcggccttttctctcctgtgggcaggtccagtgaatgctggtgtcactcagaccccaaaattccacatcctgaagacaggacagagcatgacactgcagtgtgcccaggatatgaaccatggatacatgtcctggtatcgacaagacccaggcatggggctgagactgatttactactcagctgctgctggtactactgacaaagaagtccccaatggctacaatgtctctagattaaacacagaggatttcccactcaggctggtgtcggctgctccctcccggacatctgtgtacttgtgtgccagcagttactc

SEQ ID NO: 188877 - DNA, 344 bp, Homo sapiens
  Payload ID: 17275
  Gene Symbol: TRBV6-9
  Gene Name: T cell receptor beta variable 6-9
  ENST ID: ENST00000634093
  CDS Start-End: 1-344
atgagcatcgggctcctgtgctgtgtggccttttctctcctgtgggcaggtccagtgaatgctggtgtcactcagaccccaaaattccacatcctgaagacaggacagagcatgacactgcagtgtgcccaggatatgaaccatggatacttgtcctggtatcgacaagacccaggcatggggctgaggcgcattcattactcagttgctgctggtatcactgacaaaggagaagtccccgatggctacaatgtatccagatcaaacacagaggatttcccgctcaggctggagtcagctgctccctcccagacatctgtatacttctgtgccagcagttattc

SEQ ID NO: 188878 - DNA, 380 bp, Homo sapiens
  Payload ID: 17276
  Gene Symbol: TRBV7-1
  Gene Name: T cell receptor beta variable 7-1 (non-functional)
  ENST ID: ENST00000547918
  CDS Start-End: 34-380
ctggtaaagctcccatcctgccctgaccctgccatgggcacaaggctcctctgctgggcagccatatgtctcctgggggcagatcacacaggtgctggagtctcccagtccctgagacacaaggtagcaaagaagggaaaggatgtagctctcagatatgatccaatttcaggtcataatgccctttattggtaccgacagagcctggggcagggcctggagtttccaatttacttccaaggcaaggatgcagcagacaaatcggggcttccccgtgatcggttctctgcacagaggtctgagggatccatctccactctgaagttccagcgcacacagcagggggacttggctgtgtatctctgtgccagcagctcagc

SEQ ID NO: 188879 - DNA, 380 bp, Homo sapiens; identical to SEQ ID NO: 188878
  Payload ID: 17276
  Gene Symbol: TRBV7-1
  Gene Name: T cell receptor beta variable 7-1 (non-functional)
  ENST ID: ENST00000632308
  CDS Start-End: 34-380

SEQ ID NO: 188880 - DNA, 386 bp, Homo sapiens
  Payload ID: 17277
  Gene Symbol: TRBV7-2
  Gene Name: T cell receptor beta variable 7-2
  ENST ID: ENST00000631392
  CDS Start-End: 40-386
cctgatctggtaaagctcccatcctgccctgaccctgccatgggcaccaggctcctcttctgggtggccttctgtctcctgggggcagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagcttagc

SEQ ID NO: 188881 - DNA, 394 bp, Homo sapiens
  Payload ID: 17277
  Gene Symbol: TRBV7-2
  Gene Name: T cell receptor beta variable 7-2
  ENST ID: ENST00000634605
  CDS Start-End: 48-394
acagtgatcctgatctggtaaagctcccatcctgccctgaccctgccatgggcaccaggctcctcttctgggtggccttctgtctcctgggggcagatcacacaggagctggagtctcccagtcccccagtaacaaggtcacagagaagggaaaggatgtagagctcaggtgtgatccaatttcaggtcatactgccctttactggtaccgacagagcctggggcagggcctggagtttttaatttacttccaaggcaacagtgcaccagacaaatcagggctgcccagtgatcgcttctctgcagagaggactgggggatccgtctccactctgacgatccagcgcacacagcaggaggactcggccgtgtatctctgtgccagcagcttagc

SEQ ID NO: 188882 - DNA, 397 bp, Homo sapiens
  Payload ID: 17278
  Gene Symbol: TRBV7-3
  Gene Name: T cell receptor beta variable 7-3
  ENST ID: ENST00000390361
  CDS Start-End: 51-397
ctcacagtgaccctgatctggtaaagctcccatcctgccctgactctgtcatgggcaccaggctcctctgctgggcagccctgtgcctcctgggggcagatcacacaggtgctggagtctcccagacccccagtaacaaggtcacagagaagggaaaagatgtagagctcaggtgtgatccaatttcaggtcatactgccctttactggtaccgacaaagcctggggcagggcccagagtttctaatttacttccaaggcacgggtgcggcagatgactcagggctgcccaaagatcggttctttgcagtcaggcctgagggatccgtctctactctgaagatccagcgcacagagcagggggactcagccgcgtatctccgtgccagcagcttaac

SEQ ID NO: 188883 - DNA, 397 bp, Homo sapiens
  Payload ID: 17278
  Gene Symbol: TRBV7-3
  Gene Name: T cell receptor beta variable 7-3
  ENST ID: ENST00000631882
  CDS Start-End: 51-397
ctcacagtgaccctgatctggtaaagctcccatcctgccctgactctgtcatgggcaccaggctcctctgctgggcagccctgtgcctcctgggggcagatcacacaggtgctggagtctcccagacccccagtaacaaggtcacagagaagggaaaatatgtagagctcaggtgtgatccaatttcaggtcatactgccctttactggtaccgacaaagcctggggcagggcccagagtttctaatttacttccaaggcacgggtgcggcagatgactcagggctgcccaacgatcggttctttgcagtcaggcctgagggatccgtctctactctgaagatccagcgcacagagcggggggactcagccgtgtatctctgtgccagcagcttaac

SEQ ID NO: 188884 - DNA, 347 bp, Homo sapiens
  Payload ID: 17279
  Gene Symbol: TRBV7-4
  Gene Name: T cell receptor beta variable 7-4 (gene/pseudogene)
  ENST ID: ENST00000390369
  CDS Start-End: 1-347
atgggcaccaggctcctctgctgggtggtcctgggtttcctagggacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagcgcacagagcagggggactcagctgtgtatctctgtgccagcagcttagc

SEQ ID NO: 188885 - DNA, 347 bp, Homo sapiens
  Payload ID: 17279
  Gene Symbol: TRBV7-4
  Gene Name: T cell receptor beta variable 7-4 (gene/pseudogene)
  ENST ID: ENST00000633313
  CDS Start-End: 1-347
atgggcaccaggctcctctgctgggtggtcctgggtttcctagggacagatcacacaggtgctggagtctcccagtccccaaggtacaaagtcgcaaagaggggacgggatgtagctctcaggtgtgattcaatttcgggtcatgtaaccctttattggtaccgacagaccctggggcagggctcagaggttctgacttactcccagagtgatgctcaacgagacaaatcagggcggcccagtggtcggttctctgcagagaggcctgagagatccgtctccactctgaagatccagtgcacagagcagggggactcagctgtgtatctctgtgccagcagcttagc

SEQ ID NO: 188886 - DNA, 392 bp, Homo sapiens
  Payload ID: 17280
  Gene Symbol: TRBV7-6
  Gene Name: T cell receptor beta variable 7-6
  ENST ID: ENST00000390374
  CDS Start-End: 46-392
agtgacactgatctggtaaagccctcatcctgtcctgaccctgccatgggcaccagtctcctatgctgggtggtcctgggtttcctagggacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccatctccactctgacgatccagcgcacagagcagcgggactcggccatgtatcgctgtgccagcagcttagc

SEQ ID NO: 188887 - DNA, 392 bp, Homo sapiens
  Payload ID: 17280
  Gene Symbol: TRBV7-6
  Gene Name: T cell receptor beta variable 7-6
  ENST ID: ENST00000633265
  CDS Start-End: 46-392
agtgacactgatctggtaaagccctcatcctggcctgaccctgccatgggcaccagtctcctatgctgggtggtcctgggtttcctagggacagatcacacaggtgctggagtctcccagtctcccaggtacaaagtcacaaagaggggacaggatgtagctctcaggtgtgatccaatttcgggtcatgtatccctttattggtaccgacaggccctggggcagggcccagagtttctgacttacttcaattatgaagcccaacaagacaaatcagggctgcccaatgatcggttctctgcagagaggcctgagggatccgtctccactctgacgatccagcgcacagagcagcgggactcggccatgtatcgctgtgccagcagcttagc

SEQ ID NO: 188888 - DNA, 347 bp, Homo sapiens
  Payload ID: 17281
  Gene Symbol: TRBV7-7
  Gene Name: T cell receptor beta variable 7-7
  ENST ID: ENST00000390377
  CDS Start-End: 1-347
atgggtaccagtctcctatgctgggtggtcctgggtttcctagggacagatcacacaggtgctggagtctcccagtctcccaggtacaaagtcacaaagaggggacaggatgtaactctcaggtgtgatccaatttcgagtcatgcaaccctttattggtatcaacaggccctggggcagggcccagagtttctgacttacttcaattatgaagctcaaccagacaaatcagggctgcccagtgatcggttctctgcagagaggcctgagggatccatctccactctgacgattcagcgcacagagcagcgggactcagccatgtatcgctgtgccagcagcttagc

SEQ ID NO: 188889 - DNA, 347 bp, Homo sapiens; identical to SEQ ID NO: 188888
  Payload ID: 17281
  Gene Symbol: TRBV7-7
  Gene Name: T cell receptor beta variable 7-7
  ENST ID: ENST00000631548
  CDS Start-End: 1-347

SEQ ID NO: 188890 - DNA, 347 bp, Homo sapiens
  Payload ID: 17282
  Gene Symbol: TRBV7-8
  Gene Name: T cell receptor beta variable 7-8
  ENST ID: ENST00000632560
  CDS Start-End: 1-347
atgggcaccaggctcctctgctgggtggtcctgggtttcctagggacagatcacacaggtgctggagtctcccagtcccctaggtacaaagtcgcaaagagaggacaggatgtagctctcaggtgtgatccaatttcgggtcatgtatcccttttttggtaccaacaggccctggggcaggggccagagtttctgacttatttccagaatgaagctcaactagacaaatcggggctgcccagtgatcgcttctttgcagaaaggcctgagggatccgtctccactctgaagatccagcgcacacagcaggaggactccgccgtgtatctctgtgccagcagcttagc

SEQ ID NO: 188891 - DNA, 347 bp, Homo sapiens
  Payload ID: 17283
  Gene Symbol: TRBV7-9
  Gene Name: T cell receptor beta variable 7-9
  ENST ID: ENST00000612787
  CDS Start-End: 1-347
atgggcaccagcctcctctgctggatggccctgtgtctcctgggggcagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagc

SEQ ID NO: 188892 - DNA, 347 bp, Homo sapiens
  Payload ID: 17283
  Gene Symbol: TRBV7-9
  Gene Name: T cell receptor beta variable 7-9
  ENST ID: ENST00000632021
  CDS Start-End: 1-347
atgggcaccagcctcctctgctggatggccctgtgtctcctgggggcagatcacgcagatactggagtctcccaggaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcttagc

SEQ ID NO: 188893 - DNA, 390 bp, Homo sapiens
  Payload ID: 17284
  Gene Symbol: TRBV9
  Gene Name: T cell receptor beta variable 9
  ENST ID: ENST00000390363
  CDS Start-End: 48-390
agaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcactattataatggagaagagagagcaaaaggaaacattcttgaacgattctccgcacaacagttccctgacttgcactctgaactaaacctgagctctctggagctgggggactcagctttgtatttctgtgccagcagcgtag

SEQ ID NO: 188894 - DNA, 390 bp, Homo sapiens
  Payload ID: 17284
  Gene Symbol: TRBV9
  Gene Name: T cell receptor beta variable 9
  ENST ID: ENST00000633328
  CDS Start-End: 48-390
agaatgcttactacagagacaccagccccaagctaggagatcctgccatgggcttcaggctcctctgctgtgtggccttttgtctcctgggagcaggcccagtggattctggagtcacacaaaccccaaagcacctgatcacagcaactggacagcgagtgacgctgagatgctcccctaggtctggagacctctctgtgtactggtaccaacagagcctggaccagggcctccagttcctcattcagtattataatggagaagagagagcaaaaggaaacattcttgaacgattctccgcacaacagttccctgacttgcactctgaactaaacctgagctctctggagctgggggactcagctttgtatttctgtgccagcagcgtag

SEQ ID NO: 188895 - DNA, 720 bp, Homo sapiens
  Payload ID: 17285
  Gene Symbol: TRDC
  Gene Name: T cell receptor delta constant
  ENST ID: ENST00000390477
  CDS Start-End: 1-464
gaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaagga

SEQ ID NO: 188896 - DNA, 8 bp, Homo sapiens
  Payload ID: 17286
  Gene Symbol: TRDD1
  Gene Name: T cell receptor delta diversity 1
  ENST ID: ENST00000415118
  CDS Start-End: 1-8
gaaatagt

SEQ ID NO: 188897 - DNA, 9 bp, Homo sapiens
  Payload ID: 17287
  Gene Symbol: TRDD2
  Gene Name: T cell receptor delta diversity 2
  ENST ID: ENST00000434970
  CDS Start-End: 1-9
ccttcctac

SEQ ID NO: 188898 - DNA, 13 bp, Homo sapiens
  Payload ID: 17288
  Gene Symbol: TRDD3
  Gene Name: T cell receptor delta diversity 3
  ENST ID: ENST00000448914
  CDS Start-End: 1-13
actgggggatacg

SEQ ID NO: 188899 - DNA, 51 bp, Homo sapiens
  Payload ID: 17289
  Gene Symbol: TRDJ1
  Gene Name: T cell receptor delta joining 1
  ENST ID: ENST00000390473
  CDS Start-End: 1-51
acaccgataaactcatctttggaaaaggaacccgtgtgactgtggaaccaa

SEQ ID NO: 188900 - DNA, 54 bp, Homo sapiens
  Payload ID: 17290
  Gene Symbol: TRDJ2
  Gene Name: T cell receptor delta joining 2
  ENST ID: ENST00000390475
  CDS Start-End: 1-54
ctttgacagcacaactcttctttggaaagggaacacaactcatcgtggaaccag

SEQ ID NO: 188901 - DNA, 59 bp, Homo sapiens
  Payload ID: 17291
  Gene Symbol: TRDJ3
  Gene Name: T cell receptor delta joining 3
  ENST ID: ENST00000390476
  CDS Start-End: 1-59
ctcctgggacacccgacagatgtttttcggaactggcatcaaactcttcgtggagcccc

SEQ ID NO: 188902 - DNA, 48 bp, Homo sapiens
  Payload ID: 17292
  Gene Symbol: TRDJ4
  Gene Name: T cell receptor delta joining 4
  ENST ID: ENST00000390474
  CDS Start-End: 1-48
ccagacccctgatctttggcaaaggaacctatctggaggtacaacaac

SEQ ID NO: 188903 - DNA, 365 bp, Homo sapiens
  Payload ID: 17293
  Gene Symbol: TRDV1
  Gene Name: T cell receptor delta variable 1
  ENST ID: ENST00000390452
  CDS Start-End: 19-365
caaagagctacatgccacatgctgttctccagcctgctgtgtgtatttgtggccttcagctactctggatcaagtgtggcccagaaggttactcaagcccagtcatcagtatccatgccagtgaggaaagcagtcaccctgaactgcctgtatgaaacaagttggtggtcatattatattttttggtacaagcaacttcccagcaaagagatgattttccttattcgccagggttctgatgaacagaatgcaaaaagtggtcgctattctgtcaacttcaagaaagcagcgaaatccgtcgccttaaccatttcagccttacagctagaagattcagcaaagtacttttgtgctcttggggaact

SEQ ID NO: 188904 - DNA, 102 bp, Homo sapiens
  Payload ID: 17293
  Gene Symbol: TRDV1
  Gene Name: T cell receptor delta variable 1
  ENST ID: ENST00000621643
  CDS Start-End: 1-102
aaaagtggtcgctattctgtcaacttcaagaaagcagcgaaatccgtcgccttaaccatttcagccttacagctagaagattcagcaaagtacttttgtgct

SEQ ID NO: 188905 - DNA, 520 bp, Homo sapiens
  Payload ID: 17294
  Gene Symbol: TRDV2
  Gene Name: T cell receptor delta variable 2
  ENST ID: ENST00000390469
  CDS Start-End: 176-520
attagcaggcagcaggccctgcgagcctcctgtgatcagctagatttctctggggaatgaaacagctgctgatagggactgacttcctcagtcacaagtgtttcacaagtgtgttggttcagaggagggaccaggcagaaggtggttgagaggcagagctgcccctgagtgagccatgcagaggatctcctccctcatccatctctctctcttctgggcaggagtcatgtcagccattgagttggtgcctgaacaccaaacagtgcctgtgtcaataggggtccctgccaccctcaggtgctccatgaaaggagaagcgatcggtaactactatatcaactggtacaggaagacccaaggtaacacaatgactttcatataccgagaaaaggacatctatggccctggtttcaaagacaatttccaaggtgacattgatattgcaaagaacctggctgtacttaagatacttgcaccatcagagagagatgaagggtcttactactgtgcctgtgacacc

SEQ ID NO: 188906 - DNA, 425 bp, Homo sapiens
  Payload ID: 17295
  Gene Symbol: TRDV3
  Gene Name: T cell receptor delta variable 3
  ENST ID: ENST00000535880
  CDS Start-End: 85-425
tctttcattagaaccgtcagatagtctctgagatcttaggaaccctgttttgttgtatatcctctgccctgatatgaagaaaagatgattcttactgtgggctttagctttttgtttttctacaggggcacgctgtgtgacaaagtaacccagagttccccggaccagacggtggcgagtggcagtgaggtggtactgctctgcacttacgacactgtatattcaaatccagatttattctggtaccggataaggccagattattcctttcagtttgtcttttatggggataacagcagatcagaaggtgcagattttactcaaggacggttttctgtgaaacacattctgacccagaaagcctttcacttggtgatctctccagtaaggactgaagacagtgccacttactactgtgcctttag

SEQ ID NO: 188907 - DNA, 2730 bp, Homo sapiens
  Payload ID: 17296
  Gene Symbol: TRGC1
  Gene Name: T cell receptor gamma constant 1
  ENST ID: ENST00000443402
  CDS Start-End: 1-521
ataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttgacttttgtccatggtattttaattggatgacatcaaattgaacatccaaggtaagaaacagcatggcaattgggctgtggaattctgtattggttgtaagaatggtccaacaccccatttctaattctttccctgagatcgtggttatcacaccttctaagaagaactacaaccaaatgaaggagctcatgtgacttctgtttgaaaggtcaccagagtcagattcattcggtttaggacattccagtggctataggacactatctactgtgacgcgtaccgtgtgagctcagctctagagtgtttcacagacactgtgtttcctgatcctcacgatacccccatgagagctgccctaaaagcagagaggcagcgtgatggagaggttcagcacatgctctctgatcccaggaatcctgggtatggtgtttcgtatctgtgtgacctcaggtgagttccaggaactctatgtgccataatctcctcatgtaaaatgaagttataatgccccgtttcctggagttatgtggattagatgagttaatgacacctggcacatgcaagtcctccacagtgtcggcacgcactgttggtagctctactctagagacagtaataaaccaaaaagtatctgacacaggcctcaatcaacttagaagtttattttgcctatgttaagggcatgcccaacttcctgagataataatttatttcataagaatattttaaaaactcgagtaaacttgttaatgtttattgctgcagccactctgtccatctccaccatcactgcaacaacgcaggtccttgttgcctcttattggcttatggtgaccacctataaaaccatctgcttcacccaaattgctgtcctggggagtgccccttcctttctgcttgcacatttatcttcctcaagtgcaaatgtgatcatgtgactttcctccctaaatcttttagcaagtcctcattgtctattcttctttcaaaaacatttatttgaaaatactattaaaatagaaaattttccacattcttacttcttaaaaattaatgtgttttaagtttctcctactccatttccatcccatgcctctttactcaatggatgcaattattcttctacatgttccttctggccatgtgtagctttgtcattttaattttaatctatttggaccctgtgttatctgggatgaggtagagtgatatttttattttctcaggtaattatttgcctaatgcctgtttccaaataatccaccatttccttacaatttaaaaatgctccagcatgtttttaatagctacacatatttgacacattttctggagaatttctgttttatttgtctatttcattattcttgtatcattatcatattatctcagtagctttgtggcaagtattaagatctactatgccaaatgtctattcactgtaccatttttcagaaaattctttttcaatcatctcatatttattcactcctgtagaatttaaaatcaacttatctagcctaacattaaacctcacaccctagaacaacaacatgtcgtagtaattctgactaaaattgctggaaatttatagatgaatttagggtgtattggcctctttatgatagaagctttttattcatcaatgtatgtttctccatttatttaggttttattttatgcccttaggaaaactaaatactgtgttcttcatatcattcttgtatttttttggtaaatttaataaaagattttataattca

SEQ ID NO: 188908 - DNA, 1013 bp, Homo sapiens
  Payload ID: 17297
  Gene Symbol: TRGC2
  Gene Name: T cell receptor gamma constant 2
  ENST ID: ENST00000436911
  CDS Start-End: 1-569
ataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacacgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataatggttttcaaaccagtgggcacacagagaacctcactctgtaataacaatgaggaatagccatggcgatctccagcaccaatctctccatgttttccacagctcctccagccaacccaaatagcgcctgctatagtgtagacagcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagt

SEQ ID NO: 188909 - DNA, 1060 bp, Homo sapiens
  Payload ID: 17297
  Gene Symbol: TRGC2
  Gene Name: T cell receptor gamma constant 2
  ENST ID: ENST00000610547
  CDS Start-End: 37-1002
tggtccctttccttccaaggccccagagaggaaggcatgcggtgggccctagcggtgcttctagctttcctgtctcctgccagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctgggacaggcacagtattcagacactgtctgcctgtggttcatttctccccatagataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacacgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtc

SEQ ID NO: 188910 - DNA, 50 bp, Homo sapiens
  Payload ID: 17298
  Gene Symbol: TRGJ1
  Gene Name: T cell receptor gamma joining 1
  ENST ID: ENST00000390337
  CDS Start-End: 1-50
gaattattataagaaactctttggcagtggaacaacacttgttgtcacag

SEQ ID NO: 188911 - DNA, 50 bp, Homo sapiens; identical to SEQ ID NO: 188910
  Payload ID: 17299
  Gene Symbol: TRGJ2
  Gene Name: T cell receptor gamma joining 2
  ENST ID: ENST00000390333
  CDS Start-End: 1-50

SEQ ID NO: 188912 - DNA, 61 bp, Homo sapiens
  Payload ID: 17300
  Gene Symbol: TRGJP
  Gene Name: T cell receptor gamma joining P
  ENST ID: ENST00000390338
  CDS Start-End: 1-61
gggcaagagttgggcaaaaaaatcaaggtatttggtcccggaacaaagcttatcattacag

SEQ ID NO: 188913 - DNA, 60 bp, Homo sapiens
  Payload ID: 17301
  Gene Symbol: TRGJP1
  Gene Name: T cell receptor gamma joining P1
  ENST ID: ENST00000390339
  CDS Start-End: 1-60
ataccactggttggttcaagatatttgctgaagggactaagctcatagtaacttcacctg

SEQ ID NO: 188914 - DNA, 60 bp, Homo sapiens
  Payload ID: 17302
  Gene Symbol: TRGJP2
  Gene Name: T cell receptor gamma joining P2
  ENST ID: ENST00000390334
  CDS Start-End: 1-60
atagtagtgattggatcaagacgtttgcaaaagggactaggctcatagtaacttcgcctg

SEQ ID NO: 188915 - DNA, 465 bp, Homo sapiens
  Payload ID: 17303
  Gene Symbol: TRGV1
  Gene Name: T cell receptor gamma variable 1 (non-functional)
  ENST ID: ENST00000390348
  CDS Start-End: 115-465
tactgtcttctgtgctagggatcacttccttgttgagtggggcctgagttttaagaggatcttctgctcctcttcatctggtccctttccttccaaggccccagagaggaaggcatgcggtgggccctagcggtgcttctagctttcctgtctcctgccagtcagatatcttccaacttggaagggagaacgaagtcagtcaccaggctgactgggtcatctgctgaaatcacctgtgatcttcctggagcaagtaccttatacatccactggtacctgcaccaggaggggaaggccccacagtgtcttctgtactatgaaccctactactccagggttgtgctggaatcaggaatcactccaggaaagtatgacactggaagcacaaggagcaattggaatttgagactgcaaaatctaattaaaaatgattctgggttctattactgtgccacctgggacagg

SEQ ID NO: 188916 - DNA, 512 bp, Homo sapiens
  Payload ID: 17304
  Gene Symbol: TRGV10
  Gene Name: T cell receptor gamma variable 10 (non-functional)
  ENST ID: ENST00000390341
  CDS Start-End: 160-512
actttcctgccttctccttgggtacaccgccccgaagacaggatgtcactgctggaagcatttgccttctcctcctgggctcctgagttgctgtccgaacatttcagtctagctgcgtgaccaaaatcattcttcaatgtttccctcttctactgtcagatgttcattggaaattctcctcttttacttacagttggacttggattatcaaaagtggagcagttccagctatccatttccacggaagtcaagaaaagtattgacataccttgcaagatatcgagcacaaggtttgaaacagatgtcattcactggtaccggcagaaaccaaatcaggctttggagcacctgatctatattgtctcaacaaaatccgcagctcgacgcagcatgggtaagacaagcaacaaagtggaggcaagaaagaattctcaaactctcacttcaatccttaccatcaagtccgtagagaaagaagacatggccgtttactactgtgctgcgtgggatta

SEQ ID NO: 188917 - DNA, 463 bp, Homo sapiens
  Payload ID: 17305
  Gene Symbol: TRGV11
  Gene Name: T cell receptor gamma variable 11 (non-functional)
  ENST ID: ENST00000390340
  CDS Start-End: 155-463
atgccactggtagtagctgttatcttcttctccctctgggtttgtgagttgccccctaatcatttcagtctacagaagagattgaagtcattctgtattattacctcttcacgtatcgttggcttatgggaatttctcttcacttgcaattgcacttgggcagttggaacaacctgaaatatctatttccagaccagcaaataagagtgcccacatatcttggaaggcatccatccaaggctttagcagtaaaatcatacactggtactggcagaaaccaaacaaaggcttagaatatttattacatgtcttcttgacaatctctgctcaagattgctcaggtgggaagactaagaaacttgaggtaagtaaaaatgctcacacttccacttccactttgaaaataaagttcttagagaaagaagatgaggtggtgtaccactgtgcctgctggattaggcac

SEQ ID NO: 188918 - DNA, 544 bp, Homo sapiens
  Payload ID: 17306
  Gene Symbol: TRGV2
  Gene Name: T cell receptor gamma variable 2
  ENST ID: ENST00000426402
  CDS Start-End: 191-544
ggaaggcttgggagtcctcttagacagatcctcagtcacttccctctgcttgtgtctcaggaagaccacctcctcctactgtcttctgtgctagggatcacttccttgttgagtggaacctgagttttaagaggatcttctgctcctcttcatctggtccctttccttccaaggccccagagaggaaggcatgcagtgggccctagcggtgcttctagctttcctgtctcctgccagtcagaaatcttccaacttggaagggagaacgaagtcagtcatcaggcagactgggtcatctgctgaaatcacttgtgatcttgctgaaggaagtaacggctacatccactggtacctacaccaggaggggaaggccccacagcgtcttcagtactatgactcctacaactccaaggttgtgttggaatcaggagtcagtccagggaagtattatacttacgcaagcacaaggaacaacttgagattgatactgcgaaatctaattgaaaatgactttggggtctattactgtgccacctgggacggg

SEQ ID NO: 188919 - DNA, 537 bp, Homo sapiens
  Payload ID: 17307
  Gene Symbol: TRGV3
  Gene Name: T cell receptor gamma variable 3
  ENST ID: ENST00000390346
  CDS Start-End: 184-537
cttgggagtcccctaagacacatcttcagtcacttctctctgcctgtgtctcaggaaaccagctcctcctactgtcttctgtgctagggatcacttccttgttgagtggggcctgagttttaagaggatcttctgctcctcttcatctggtccgtttccttccaaggcccccgagaggaaggcatgcggtgggccctactggtgcttctagctttcctgtctcctgccagtcagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctgggacagg

SEQ ID NO: 188920 - DNA, 688 bp, Homo sapiens
  Payload ID: 17308
  Gene Symbol: TRGV4
  Gene Name: T cell receptor gamma variable 4
  ENST ID: ENST00000390345
  CDS Start-End: 335-688
ggcctgagctctcctggcccctggctctcttctgcagagggcctgctctcagctgccacaagagggcgccggagaacggacctgagcaagagaggcaggagctcctctgcaggtcctcccaggcaccaatccttctgggagggaggaaggcttgggagtcctcttagacagatcctcagtcacttctctctgcttgtgtctcaggaagaccagctcctcctactgtcttctgtgctagggatcacttccttgttgagtggggcctgagttttaagaggatcttctgctcctcttcatctggtccctttccttccaaggcctcagagaggaaggcatgcagtgggccctagcggtgcttctagctttcctgtctcctgccagtcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttacggaagcacaaggaagaacttgagaatgatactgcgaaatcttattgaaaatgactctggagtctattactgtgccacctgggatggg

SEQ ID NO: 188921 - DNA, 552 bp, Homo sapiens
  Payload ID: 17309
  Gene Symbol: TRGV5
  Gene Name: T cell receptor gamma variable 5
  ENST ID: ENST00000390344
  CDS Start-End: 199-552
ttctgggaggaaggcttgggagtcccctaagacacatcttcagtcacttctctctgcctgtgactcaggaagaccagctcctcctactgtcttctgtgctagggatcacttccttgttgagtggggccggagttttaagaggatcttctgctcctcctcatctggtccctttccttccaaggcccccgagaggaaggcatgcggtgggccctactggtgcttctagctttcctgtctcctgccagtcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctgggacagg

SEQ ID NO: 188922 - DNA, 2233 bp, Homo sapiens
  Payload ID: 17309
  Gene Symbol: TRGV5
  Gene Name: T cell receptor gamma variable 5
  ENST ID: ENST00000613175
  CDS Start-End: 188-544
aggcttgggagtcccctaagacacatcttcagtcacttctctctgcctgtgactcaggaagaccagctcctcctactgtcttctgtgctagggatcacttccttgttgagtggggccggagttttaagaggatcttctgctcctcctcatctggtccctttccttccaaggcccccgagaggaaggcatgcggtgggccctactggtgcttctagctttcctgtctcctgccagtcagaaatcttccaacttggaagggggaacgaagtcagtcacgaggccgactaggtcatctgctgaaatcacttgtgaccttactgtaataaatgccttctacatccactggtacctacaccaggaggggaaggccccacagcgtcttctgtactatgacgtctccaactcaaaggatgtgttggaatcaggactcagtccaggaaagtattatactcatacacccaggaggtggagctggatattgatactacgaaatctaattgaaaatgattctggggtctattactgtgccacctgggacaggcacagtgattcagacctgtcctacaccacactgaaaatctgccttgtggctgcctctggttcacaggatagagccgccccctctcatttcctgtcaccaaatttactgtattctgaacaagagaaagacagcttaactcctgatctccctcctaatatcacactgtcctggcagcagccgcaccctgttccccacccctcccccacaactttcctgaagatcaagctgccatctccaggcctcagccagtcagaaatcttccaacttggaagggagaatgaagtcagtcaccaggccgactgggtcatctgctgaaatcacttgtgaccttactgtaataaatgccgtctacatccactggtacctacagcaggaggggaagaccccacagcatcttctgcactatgatgtctccaactcaagggatgtgttggaatcaggtctcagtcttggaaagtattatactcatacaccgaggaggtggagctggaatttgagactgcaaaatctaattgaaaatgattctggggtctattactgtgccacctggggcaggcacagtgattcagatctgccctacaccacactgaacatctgccttgtggctgcctctggtacacaagatagagccgccccctctcatttcctgccaccaaatttactgtattctgaacaagagaaagacagcttaactcctgatctccctcctaatatcacactgtcctggcagcagctgcaccctgttccctacccctcccccacaactttcctgaagatcaagctgccatctccgggcctcagttaagcagcctggctgagagtaaggttctctcagctctcctaggacatgggggaggcccactcactctgcttcctatgacagacaggtacaactagggtccagctgcgaatctagatattttggacagcaaataggaaggttatttatactgaatcatttatccagtcatggtccagagatcacagctgagagtggtgcttattccttatgtctataacaatataagcaatagtataatgaccactaaaacactaggcctaggtatgcagttgaacattctctccctctgccctcccttttattctctctctcttttttcttacttctttgcttgtttttatttttctctccctccctaactccctccctccatccatcctttcctcccttcctcccttgtttccttccatccattctccttccttgttttcctccttccttccttgtttttctctctctttctttcctttttgggtacataatgagaatactttttccacaaaatcatttgaaataatttttctctatttgttcatgccaacatttatacagctagtttaactgttcagttttcatttttacattttggaaatttgttgtattactttgttttgtttcaaatctgttttgtatatataaaatatttacatggaactgaagtcaaaatcataaaaggtgatgcatttgaagattttagcttccattgtagatttcttgttcctcttttctccctgacactacaggtaacaatatttttgtcagttcacttgagctgtttcactctgtttgtcatagcagagtatgtattgtttctatttcaatgccatatttatattttcattctgatatttggtttttatacattttaataaatcttatattttcctgtg

SEQ ID NO: 188923 - DNA, 468 bp, Homo sapiens
  Payload ID: 17310
  Gene Symbol: TRGV8
  Gene Name: T cell receptor gamma variable 8
  ENST ID: ENST00000390343
  CDS Start-End: 115-468
ctactgtcttctgtgttagggatcacttccttgttgagtgggacctgagttttgagagggtcttctgctcctcttcgtctggtcccttacttccaagaccccagagaggaaggcatgctgttggctctagctctgcttctagctttcctgcctcctgccagtcagaaatcttccaacttggaagggagaacaaagtcagtcaccaggccaactgggtcatcagctgtaatcacttgtgatcttcctgtagaaaatgccgtctacacccactggtacctacaccaggaggggaaggccccacagcgtcttctgtactatgactcctacaactccagggttgtgttggaatcaggaatcagtcgagaaaagtatcatacttatgcaagcacagggaagagccttaaatttatactggaaaatctaattgaacgtgactctggggtctattactgtgccacctgggatagg

SEQ ID NO: 188924 - DNA, 1735 bp, Homo sapiens
  Payload ID: 17311
  Gene Symbol: TRGV9
  Gene Name: T cell receptor gamma variable 9
  ENST ID: ENST00000444775
  CDS Start-End: 1370-1735
aaaaaaattcaagtcaatccatagaagtgggtcgtggaattccaggcagaaagtgactaaatgaagatggaaggacagggagggggtggccacatcacagagaacctcttatcctaagaactctggacttcatcttcagaggcaaggtagagagagcaaggactttagagcaggaaaaggaccaggtcagtctagtggccatggggaaggtgggtgggaggggccgagatgggatgtatggaggtgcgtgaggtggaggcagtggtgagccaggaaatgtttaggacgtagaatcctcaggaattagagtgcggtgaattagaggggagaattgaggctgatgctcaagctcctggcttgggcaatgtgggtagttatgtcatacagggaactcggaagaagatatggtttgggggaagggaatgagttcactctggctatgagcagactttgtttgagatcccatgtcagacgtacttgaaaatgtccaagagttagctggatatgggtacagacagctttcgatttaactgaggtccgacttaagatttttttttactttatgatggtgcaaaagtgacacgcatttggtagaaaacataatttgacctttgctgtttccccaggacagtgatataaggttatgatactctcttgcgatgctgggcagtggcagtgagctgcagctcccagtgggtaaattaagcatggaaatctggaacacagcagcttttaagggatgcactggggagagcagtttgtaaaaataccttgggacggattaaatgtcttggcttagagaaagaacaacagacaataggaaactgtcattgaggagaagccgggattcaggagatgtacattattcaggtagctgagggaggggacaggaacctgaatcttcaacagaagcaaacaaactgggatggagggcccagcctcatgaaggtgaccagaaggacccggtgctgcaggctgtgtgggtagctgagcagagctaagcggcttgacggaccaacatctctccagctggttgaagacaagctctcagaagacaatgctgcatgtcacagccccagcaaccaacaacaccagcctgacaacttgctggggtggccgccttgtggtctgaggtggccgtctaaactatgtggtctgatctcaggctgcagaccttgcaggactgtcttcacacagactggaagtgctaacaggtggtgaggacaccgctttacaacgatgcagggggccccatgtcaccctcacccatgggaagtttgacttggtggactcagccaagccacagaggtctaacgcttctctgcggtgatttcaggctgccctggcagaaagcacagtgcctgcagacatgctgtcactgctccacacatcaacgctggcagtccttggggctctgtgtgtatatggtgcaggtcacctagagcaacctcaaatttccagtactaaaacgctgtcaaaaacagcccgcctggaatgtgtggtgtctggaataacaatttctgcaacatctgtatattggtatcgagagagacctggtgaagtcatacagttcctggtgtccatttcatatgacggcactgtcagaaaggaatccggcattccgtcaggcaaatttgaggtggataggatacctgaaacgtctacatccactctcaccattcacaatgtagagaaacaggacatagctacctactactgtgccttgtgggaggtg

SEQ ID NO: 188925 - DNA, 897 bp, Homo sapiens
  Payload ID: 17312
  Gene Symbol: TARM1
  Gene Name: T cell-interacting, activating receptor on myeloid cells 1
  Uniprot ID: B6A8C7
  ENST ID: ENST00000432826
  CDS Start-End: 26-841
actctgggagggctaaggagccatcatgatccctaagctgctttccctcctctgtttcagactgtgcgtgggccaaggagacacaaggggagatgggtcactgcccaagccgtccctcagtgcctggcccagctcggtggtccctgccaacagcaatgtgacgctgcgatgttggactcctgccagaggtgtgagctttgttctcaggaagggaggaattattctggagtccccgaagccccttgattctacagagggcgcggccgaatttcacctcaataatctaaaagtcagaaatgctggagagtacacctgtgaatactacagaaaagcatccccccacatcctttcacagcacagtgacgtccttctactgttggtgacaggacatttatctaaacctttcctccgaacctaccaaaggggtacagtgaccgcaggtggaagggtgactctgcagtgccagaagcgagaccaattgtttgtgcctatcatgttcgctctactgaaggcagggacgccatcacccatccagctgcagagtccagcggggaaggagatagacttctctctggtggacgtgacagccggcgatgctgggaactacagctgcatgtactaccagacaaagtctcccttctgggcctcagaacccagtgatcagcttgagatattggtgacagttcccccaggtaccacatcgagcaactactccctgggtaacttcgtacgactgggtctggctgccgtaattgtggttatcatgggagctttcctggtggaggcctggtacagccggaatgtgtctccaggtgaatcagaggccttcaaaccagagtgactccatcttgaaccggggctgggtaaactgaggctgcaacctgctggactgcattc

SEQ ID NO: 188926 - DNA, 1234 bp, Homo sapiens
  Payload ID: 17312
  Gene Symbol: TARM1
  Gene Name: T cell-interacting, activating receptor on myeloid cells 1
  Uniprot ID: B6A8C7
  ENST ID: ENST00000620140
  CDS Start-End: 287-1126
actaataatacaaaactcagccgggcgtcctggcgcatgcctgtgatcccagctatttgggaggctgaggcaggagaatcacttgaacccgggaggcggaggttgcagtgagccgagattgcgtcactctactccagcctgggcgacagagcgcaactctgtctctggaatgaatgaaagaaagaaagaatgaatgaaagaaagaaagaatgaatgaaagaaagaaagaaagaaaaagaaagaaagagcgagactctgtctctggaatgaatgaaagaaagaatgaatgaaagaaagaaaaaagaaagaaagaaaggaaagaaaaagaaagaaagaaagaaatggactgtgcgtgggccaaggagacacaaggggagatgggtcactgcccaagccgtccctcagtgcctggcccagctcggtggtccctgccaacagcaatgtgacgctgcgatgttggactcctgccagaggtgtgagctttgttctcaggaagggaggaattattctggagtccccgaagccccttgattctacagagggcgcggccgaatttcacctcaataatctaaaagtcagaaatgctggagagtacacctgtgaatactacagaaaagcatccccccacatcctttcacagcgcagtgacgtccttctactgttggtgacaggacatttatctaaacctttcctccgaacctaccaaaggggtacagtgaccgcaggtggaagggtgactctgcagtgccagaagcgagaccaattgtttgtgcctatcatgttcgctctactgaaggcagggacgccatcacccatccagctgcagagtccagcggggaaggagatagacttctctctggtggacgtgacagccggcgatgctgggaactacagctgcatgtactaccagacaaagtctcccttctgggcctcagaacccagtgatcagcttgagatattggtgacagttcccccaggtaccacatcgagcaactactccctgggtaacttcgtacgactgggtctggctgccgtaattgtggttatcatgggagctttcctggtggaggcctggtacagccggaatgtgtctccaggtgaatcagaggccttcaaaccagagtgactccatcttgaaccggggctgggtaaactgaggctgcaacctgctggactgcattcccagggggttgaggctttctaagtcacaggatgagacaggtcacaacataca

SEQ ID NO: 188927 - DNA, 897 bp, Homo sapiens
  Payload ID: 17312
  Gene Symbol: TARM1
  Gene Name: T cell-interacting, activating receptor on myeloid cells 1
  ENST ID: ENST00000611419
  CDS Start-End: 26-841
actctgggagggctaaggagccatcatgatccctaagctgctttccctcctctgtttcagactgtgcgtgggccaaggagacacaaggggagatgggtcactgcccaagccgtccctcagtgcctggcccagctcggtggtccctgccaacagcaatgtgacgctgcgatgttggactcctgccagaggtgtgagctttgttctcaggaagggaggaattattctggagtccccgaagccccttgattctacagagggcgcggccgaatttcacctcaataatctaaaagtcagaaatgctggagagtacacctgtgaatactacagaaaagcatccccccacatcctttcacagcgcagtgacgtccttctactgttggtgacaggacatttatctaaacctttcctccgaacctaccaaaggggtacagtgaccgcaggtggaagggtgactctgcagtgccagaagcgagaccaattgtttgtgcctatcatgttcgctctactgaaggcagggacgccatcacccatccagctgcagagtccagcggggaaggagatagacttctctctggtggacgtgacagccggcgatgctgggaactacagctgcatgtactaccagacaaagtctcccttctgggcctcagaacccagtgatcagcttgagatattggtgacagttcccccaggtaccacatcgagcaactactccctgggtaacttcgtacgactgggtctggctgccgtaattgtggttatcatgggagctttcctggtggaggcctggtacagccggaatgtgtctccaggtgaatcagaggccttcaaaccagagtgactccatcttgaaccggggctgggtaaactgaggctgcaacctgctggactgcattc

SEQ ID NO: 188928 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  ENST ID: ENST00000622245
  CDS Start-End: 26-841

SEQ ID NO: 188929 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  ENST ID: ENST00000619320
  CDS Start-End: 26-841

SEQ ID NO: 188930 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  Uniprot ID: B6A8C7
  ENST ID: ENST00000615726
  CDS Start-End: 26-841

SEQ ID NO: 188931 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  ENST ID: ENST00000620398
  CDS Start-End: 26-841

SEQ ID NO: 188932 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  ENST ID: ENST00000611088
  CDS Start-End: 26-841

SEQ ID NO: 188933 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  Uniprot ID: B6A8C7
  ENST ID: ENST00000614463
  CDS Start-End: 26-841

SEQ ID NO: 188934 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  Uniprot ID: B6A8C7
  ENST ID: ENST00000620707
  CDS Start-End: 26-841

SEQ ID NO: 188935 - DNA, 897 bp, Homo sapiens; identical to SEQ ID NO: 188927
  Payload ID: 17312
  Gene Symbol: TARM1
  Gene Name: T cell-interacting, activating receptor on myeloid cells 1
  ENST ID: ENST00000612678
  CDS Start-End: 26-841

SEQ ID NO: 188936 - DNA, 1218 bp, Homo sapiens
  Payload ID: 17312
  Gene Symbol: TARM1
  Gene Name: T cell-interacting, activating receptor on myeloid cells 1
  ENST ID: ENST00000616041
  CDS Start-End: 271-1110
actaataatacaaaactcagccgggcgtcctggcgcatgcctgtgatcccagctatttgggaggctgaggcaggagaatcacttgaacccgggaggcggaggttgcagtgagccgagattgcgtcactctactccagcctgggcgacagagcgcaactctgtctctggaatgaatgaaagaaagaaagaatgaatgaaagaaagaaagaaagaaagaaaaagaaagaaagagcgagactctgtctctggaatgaatgaaagaaagaatgaatgaaagaaagaaaaaagaaagaaagaaaggaaagaaaaagaaagaaagaaagaaatggactgtgcgtgggccaaggagacacaaggggagatgggtcactgcccaagccgtccctcagtgcctggcccagctcggtggtccctgccaacagcaatgtgacgctgcgatgttggactcctgccagaggtgtgagctttgttctcaggaagggaggaattattctggagtccccgaagccccttgattctacagagggcgcggccgaatttcacctcaataatctaaaagtcagaaatgctggagagtacacctgtgaatactacagaaaagcatccccccacatcctttcacagcacagtgacgtccttctactgttggtgacaggacatttatctaaacctttcctccgaacctaccaaaggggtacagtgaccgcaggtggaagggtgactctgcagtgccagaagcgagaccaattgtttgtgcctatcatgttcgctctactgaaggcagggacgccatcacccatccagctgcagagtccagcggggaaggagatagacttctctctggtggacgtgacagccggcgatgctgggaactacagctgcatgtactaccagacaaagtctcccttctgggcctcagaacccagtgatcagcttgagatattggtgacagttcccccaggtaccacatcgagcaactactccctgggtaacttcgtacgactgggtctggctgccgtaattgtggttatcatgggagctttcctggtggaggcctggtacagccggaatgtgtctccaggtgaatcagaggccttcaaaccagagtgactccatcttgaaccggggctgggtaaactgaggctgcaacctgctggactgcattcccagggggttgaggctttctaagtcacaggatgagacaggtcacaacataca

SEQ ID NO: 188937 - DNA, 1120 bp, Homo sapiens
  Payload ID: 17313
  Gene Symbol: TAC3
  Gene Name: tachykinin 3
  Uniprot ID: Q9UHF0
  ENST ID: ENST00000300108
  CDS Start-End: 140-505
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaatagggtattaaagctcatagatttgccctgaaatacactgccaatgcccagcacactgtcggccaaacacaaagacacttagaggcacgtgtgtttgtacacatcccccgtctttcatctctttcctctggatcatggacggcagctgactattgagcaggactctttcagagggacccataattgcagctttcataatcttaccattgagggagcattcccaacctgttaggtgtcaggcagaataggacataaggtttctgggagctggcatttaaagattagatgagatggatcaacacagatcattgtgtcatctgatttcattcatgtgaaacttactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 188938 - DNA, 930 bp, Homo sapiens
  Payload ID: 17313
  Gene Symbol: TAC3
  Gene Name: tachykinin 3
  Uniprot ID: Q9UHF0
  ENST ID: ENST00000357616
  CDS Start-End: 158-565
agtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagagggaaagacaggacctttcttaccttcagtgagggttcctcggccccttcatcccaatcagcttggatccacaggaaagtcttccctgggaacagaggagcagagacctttataagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaa

SEQ ID NO: 188939 - DNA, 1066 bp, Homo sapiens
  Payload ID: 17313
  Gene Symbol: TAC3
  Gene Name: tachykinin 3
  Uniprot ID: Q9UHF0
  ENST ID: ENST00000379411
  CDS Start-End: 140-451
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacactctcctacggatgtgaatcaagagaacgtccccagctttggcatcctcaagtatcccccgagagcagaatagggtattaaagctcatagatttgccctgaaatacactgccaatgcccagcacactgtcggccaaacacaaagacacttagaggcacgtgtgtttgtacacatcccccgtctttcatctctttcctctggatcatggacggcagctgactattgagcaggactctttcagagggacccataattgcagctttcataatcttaccattgagggagcattcccaacctgttaggtgtcaggcagaataggacataaggtttctgggagctggcatttaaagattagatgagatggatcaacacagatcattgtgtcatctgatttcattcatgtgaaacttactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 188940 - DNA, 1237 bp, Homo sapiens
  Payload ID: 17313
  Gene Symbol: TAC3
  Gene Name: tachykinin 3
  Uniprot ID: Q9UHF0
  ENST ID: ENST00000393867
  CDS Start-End: 140-547
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagagggaaagacaggacctttcttaccttcagtgagggttcctcggccccttcatcccaatcagcttggatccacaggaaagtcttccctgggaacagaggagcagagacctttataagactctcctacggatgtgaatcaagagaacgtccccagctttggcatcctcaagtatcccccgagagcagaatagggtattaaagctcatagatttgccctgaaatacactgccaatgcccagcacactgtcggccaaacacaaagacacttagaggcacgtgtgtttgtacacatcccccgtctttcatctctttcctctggatcatggacggcagctgactattgagcaggactctttcagagggacccataattgcagctttcataatcttaccattgagggagcattcccaacctgttaggtgtcaggcagaataggacataaggtttctgggagctggcatttaaagattagatgagatggatcaacacagatcattgtgtcatctgatttcattcatgtgaaacttactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 188941 - DNA, 588 bp, Homo sapiens
  Payload ID: 17313
  Gene Symbol: TAC3
  Gene Name: tachykinin 3
  Uniprot ID: Q9UHF0
  ENST ID: ENST00000415231
  CDS Start-End: 222-587
aggttctcagtgaggttcaaggagaacagtgtggctgtcaaggtcgtccagggccctgcaggtggtgacaacagcaagctacgctacaaaaaaaaggggagtcattgcttggaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaatagg

SEQ ID NO: 188942 - DNA, 816 bp, Homo sapiens
  Payload ID: 17313
  Gene Symbol: TAC3
  Gene Name: tachykinin 3
  Uniprot ID: Q9UHF0
  ENST ID: ENST00000458521
  CDS Start-End: 161-526
ctgagtgactgcagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttttgcatatgaa

SEQ ID NO: 188943 - DNA, 1060 bp, Homo sapiens
  Payload ID: 17313
  Gene Symbol: TAC3
  Gene Name: tachykinin 3
  Uniprot ID: Q9UHF0
  ENST ID: ENST00000438756
  CDS Start-End: 140-547
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacgtgacatgcatgacttctttgtgggacttatgggcaagaggagcgtccagccagagggaaagacaggacctttcttaccttcagtgagggttcctcggccccttcatcccaatcagcttggatccacaggaaagtcttccctgggaacagaggagcagagacctttataagactctcctacggatgtgaatcaagagaacgtccccagctttggcatcctcaagtatcccccgagagcagaatagggtattaaagctcatagatttgccctgaaatacactgccaatgcccagcacactgtcggccaaacacaaagacacttagaggcacgtgtgtttgtacacatcccccgtctttcatctctttcctctggatcatggacggcagctgactattgagcaggatactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 188944 - DNA, 731 bp, Homo sapiens
  Payload ID: 17313
  Gene Symbol: TAC3
  Gene Name: tachykinin 3
  Uniprot ID: Q9UHF0
  ENST ID: ENST00000441881
  CDS Start-End: 140-451
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacactctcctacggatgtgaatcaagagaacgtccccagctttggcatcctcaagtatcccccgagagcagaataggtactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 188945 - DNA, 889 bp, Homo sapiens
  Payload ID: 17313
  Gene Symbol: TAC3
  Gene Name: tachykinin 3
  Uniprot ID: Q9UHF0
  ENST ID: ENST00000423597
  CDS Start-End: 140-451
agatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagactcttcaaaagccactcatctctggagggattgctcaaagccctgagccaggctagcacagatcctaaggaatcaacatctcccgagaaacactctcctacggatgtgaatcaagagaacgtccccagctttggcatcctcaagtatcccccgagagcagaatagggtattaaagctcatagatttgccctgaaatacactgccaatgcccagcacactgtcggccaaacacaaagacacttagaggcacgtgtgtttgtacacatcccccgtctttcatctctttcctctggatcatggacggcagctgactattgagcaggatactccacttccggactcctggactgcattaggaagacctctttccctgtcccaatccccaggtgcgcacgctcctgttaccctttctcttccctgttcttgtaacattcttgtgctttgactccttctccatcttttctacctgaccctggtgtggaaactgcatagtgaatatccccaaccccaatgggcattgactgtagaataccctagagttcctgtagtgtcctacattaaaaatataatgtctctctctattcctcaacaataaaggatttt

SEQ ID NO: 188946 - DNA, 1120 bp, Homo sapiens; identical to SEQ ID NO: 188937
  Payload ID: 17313
  Gene Symbol: TAC3
  Gene Name: tachykinin 3
  Uniprot ID: Q9UHF0
  ENST ID: ENST00000615887
  CDS Start-End: 140-505

SEQ ID NO: 188947 - DNA, 597 bp, Homo sapiens
  Payload ID: 17314
  Gene Symbol: TAC4
  Gene Name: tachykinin 4 (hemokinin)
  Uniprot ID: Q86UU9
  ENST ID: ENST00000326219
  CDS Start-End: 1-264
atgctgccttgcctcgccctgcttctcctgatggagctgtccgtgtgcactgtggcaggtgatggtggagaggaacagacactcagcactgaagcagagacctgggaaggcgctggccccagcattcagctccagctgcaggaggtgaagacgggcaaggcaagccagttctttgggctgatggggaagcgagtgggaggaagacctctgatccagccaaggagaaaaaaaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 188948 - DNA, 675 bp, Homo sapiens
  Payload ID: 17314
  Gene Symbol: TAC4
  Gene Name: tachykinin 4 (hemokinin)
  Uniprot ID: Q86UU9
  ENST ID: ENST00000334568
  CDS Start-End: 1-342
atgctgccttgcctcgccctgcttctcctgatggagctgtccgtgtgcactgtggcaggtgatggtggagaggaacagacactcagcactgaagcagagacctgggtaattgtggccttggaggaaggcgctggccccagcattcagctccagctgcaggaggtgaagacgggcaaggcaagccagttctttgggctgatggggaagcgagtgggaggaagacctctgatccagccaaggagaaaaaaagcatatcagctggaacacacgttccagggcctcctgggcaagagaagcctgttcacagaaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 188949 - DNA, 564 bp, Homo sapiens
  Payload ID: 17314
  Gene Symbol: TAC4
  Gene Name: tachykinin 4 (hemokinin)
  Uniprot ID: Q86UU9
  ENST ID: ENST00000352793
  CDS Start-End: 1-231
atgctgccttgcctcgccctgcttctcctgatggagctgtccgtgtgcactgtggcaggtgatggtggagaggaacagacactcagcactgaagcagagacctgggaaggcgctggccccagcattcagctccagctgcaggaggtgaagacgggcaaggcaagccagttctttgggctgatggggaagcgagtgggaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 188950 - DNA, 624 bp, Homo sapiens
  Payload ID: 17314
  Gene Symbol: TAC4
  Gene Name: tachykinin 4 (hemokinin)
  Uniprot ID: Q86UU9
  ENST ID: ENST00000398154
  CDS Start-End: 1-291
atgctgccttgcctcgccctgcttctcctgatggagctgtccgtgtgcactgtggcaggtgatggtggagaggaacagacactcagcactgaagcagagacctgggaaggcgctggccccagcattcagctccagctgcaggaggtgaagacgggcaaggcaagccagttctttgggctgatggggaagcgagtgggagcatatcagctggaacacacgttccagggcctcctgggcaagagaagcctgttcacagaaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 188951 - DNA, 657 bp, Homo sapiens
  Payload ID: 17314
  Gene Symbol: TAC4
  Gene Name: tachykinin 4 (hemokinin)
  Uniprot ID: Q86UU9
  ENST ID: ENST00000436235
  CDS Start-End: 1-324
atgctgccttgcctcgccctgcttctcctgatggagctgtccgtgtgcactgtggcaggtgatggtggagaggaacagacactcagcactgaagcagagacctgggaaggcgctggccccagcattcagctccagctgcaggaggtgaagacgggcaaggcaagccagttctttgggctgatggggaagcgagtgggaggaagacctctgatccagccaaggagaaaaaaagcatatcagctggaacacacgttccagggcctcctgggcaagagaagcctgttcacagaaggcagagaggatgaggcccaaggttcagagtaaaagcccccaccacagacttcccagaggacacggtgccgcttcttcctacctggatgtcacagctgacaagccggcaggccaactctcttctctgtgtctcctgtcctcatcgctggcacttcacacaaggcccacactgaacccactgggcttcttcctggactctcagtgtcaagcagcagtcctgcataaatgcacagcttcgccgtagcaagctgcactgactctgccctccctcacactcagagttggcatctcactgcacagcagtgaggagactcgcacactctgtatcctgtgcctagcacacagtaggcactcaataaatgagtg

SEQ ID NO: 188952 - DNA, 455 bp, Homo sapiens
  Payload ID: 17314
  Gene Symbol: TAC4
  Gene Name: tachykinin 4 (hemokinin)
  ENST ID: ENST00000503603
  CDS Start-End: 1-162
atgctgccttgcctcgccctgcttctcctgatggagctgtccgtgtgcactgtggcaggtgatggtggagaggaacagacactcagcactgaagcagagacctgggtaattgtggccttggaggtacttttggggagaggctctgacgagggcaggggataatcggcagtgcagaggcagaagatcccctgcatggctgctgggagagcaggcagtctgcaaggcaagttgtctgactctctaccatgggtagattcaaggctatgagccctggcctggcagacctccgaagtgtgtgtgtgtgtgtgtgtgtgtgtgtgtgtgtctgtgtgtgtgtgtgtgtgtgtaagaaatacttatttaacacacggtatatctctggcactgtctgaaatgctttataaatattaactcaatcctcccatcaacctcatggggaagcgagtgggaggtga

SEQ ID NO: 188953 - DNA, 4959 bp, Homo sapiens
  Payload ID: 17315
  Gene Symbol: TACR1
  Gene Name: tachykinin receptor 1
  Uniprot ID: P25103
  ENST ID: ENST00000305249
  CDS Start-End: 767-1990
acggcaagtagcaagcagcaaaaggcgtggtagctgcggcggtggaatgagacagttgtcaacagctggcgcagctgccgcgctgcgcaccgggactggcgagtacgcagcccaggtactgccccttcccagtgacgtctctgcagggggttataaaagcctcgtgcgcagctaactcgcgagctgagcaacccgaaccgagaggtgcccgcgaaactgcaggcggcggcagcggcagcaaaagagaaggaaaaatctccagctggatacgaagctccagaatcctggccataggctcagaacttttacaggtcgcgctgcaatgggcccccacttcgctcctaagtcctcacgcagcacagggctttgcctttccctgcggaggaaggagaaataggagttgcaggcagcagcaggtgcataaatgcgggggatctcttgcttcctagaactgtgaccggtggaatttctttccctttttcagtttaccgcaagagagatgctgtctccagacttctgaactcaaacgtctcctgaagcttgaaagtggaggaattcagagccaccgcgggcaggcgggcagtgcatccagaagcgtttatattctgagcgccagttcagctttcaaaaagagtgctgcccagaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcccaaaagcccattcattccattctggaagtgactttggctgcatgcgagtgctcatttcaggatgaattctgcagcacagctgcggacccggaagactcattttcctggagccccgtgttacttcaataaagttatctcagattagcctcctgcagctggaggctcctatcaccccagcctacgcttgacagggtgaacaaaagaaggcaccacataacatctaaatgaaaaatttagccctgtcttctaagcatctgtgaaaagaaacatatgtattcccctttttggcatctcagtatttcagtacatttatacatcatgagattgagaacctcgggcttccacattatgtccccggtgactgtcctgagcagccgacgcaagcagaatatgtccactgatacctgctagttctcttacagaccaggaattgggagacttgcactacatttaatgtgtagttgaccctcttttcctacttgtaaacaaggggactgaactagataatctaagtgttccttcgaatcttaacatcccgtggttcaaggattgtatgagttttttgtttgttttacaaaaaaaaacaaaacgaagaataaaagaatagaaaagaataggagcagtgagtcttgtaactaatacccagttcctggagatgtagcaactgctaaggccatctgtaactatccatctcagacattctccgatttatcttaaaatcctgagtacattccttctcatggaaggttttggcttttgacagagcagaggacttcatgccaaggcctgcatccatccagctttagcaggcagaatttcatagctgcagaacactgtcagagaagacaaatgtgggctccctgctttaaccttttgggtattttagggtgggggccctaaccttcattcttagttttacactagcatcgtgctcatatgtgcgacaagcaagaaggctgcactttgcagctgcacttctgggaagagggcatcttgcatcttcccttcagactctctgaatgtctcctccctgctccatggctttgccagcttcctgtctctaaggggtagaatgactcatcaaccctaaaggacagtcagtcttccaagagccatgaactgaatgctttatatcctaatttagatttagagtttccagaaggtgagcatgcagttttgttttgtttttttttctgtctcccaaatctgtgttttttccagatatggctggaagcagaagcttcatgtaacatccatgaatgtcctcctggtagtttgcataatggatgcacatgtgccgcatccataacattaaggggagaataatgcatggtttacagcctttgccagccctgctggctctaattctaccagggcatccacaggcctgggggaagaagaaacagtataagccagaaaacctcaagaactacattctctaaagcagcatggaaagttttaaataaactaagtgaagccagatcattgcagatatataaatggaagacaaaatttagaagcaacaaaagttagtgccctaagcattagtcatacttccaatagagaatcttgctgtgtatggattactcactttggaagaatgtaaagagctaacatgattatgagaagtacctgagaagatggtgtcaagaagttggggacaccccatctatggaagagaaggttagagttgagctcaacgaggattaactgagtgcctcctctggactttgccctgaactgggaacacacagcccctgcagctcttgaagagcctaccttattggccatcactaactaactcaccagtcctagtgagtctaagctgcccagcagtcttggaggcatctgagaggacagattctccacagaattctaaaaacccacactcaacatgggcagtcaagccaaagactgggacctttggagagcctctggaatgagagttctctggggtacttccaaagggagctggcagtcagtccaggggacctaaaggaatttggttgaacagtatcatctctgtgcatagtaagagggaatgttgggtggtccgggcagtttccaatatggcaaagcatctgcttggacagtgccagcaagccttcctctgacccagtctccaatgtccactaacttataaaaatgtcatcaactcccacatgtaagaaacaccatgatttgtactgtgcatgggtcacattcttattctagaaatgcatcaccctgtgtttatccaagtgtgtttacttggtgtaatgtccagtagtaatagaatatgaaatatcaaggaaccatctttgttacgtgacttccaaaatgtgagatctcattgctgtcactgtgatatttgtattgtgtgaatctcttcctcctcttcctcctcatgctttctcagggaggagccctgatgtatatcatgaactcacagttcctagaccacagtaattgaggggcggtgggggggcctttatcggagaagctagagaacaagagtccttctcctccttatcccccaacaggacactaagagacaaggactgagtggaatcctggagaaaggggactcaggaactgacctcattggcctgatttgtgaggagaggagtataagtggagaggggccattcctgaggtttccgtgttttccagcctggtctcctggaaagaatctttatacagaaataaagtatgtgtttcactc

SEQ ID NO: 188954 - DNA, 1270 bp, Homo sapiens
  Payload ID: 17315
  Gene Symbol: TACR1
  Gene Name: tachykinin receptor 1
  Uniprot ID: P25103
  ENST ID: ENST00000409848
  CDS Start-End: 124-1059
gaaaaagccttccaccctcctgtctggctttagaaggaccctgagccccaggcgccagccacaggactctgctgcagaggggggttgtgtacagatagtagggctttaccgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggtgaggatcccaaccccatgagctctccaggggccacaagaccatctacatacacagtggccaagcggccatcctaaatgagtaaacccagctgtgagacaagagggacaagtggggactgcagctaacttatcatcacacaactcagcctggctgattatcaccatccaggaatgggagcccggagtggactgattttctttttttcttttcca

SEQ ID NO: 188955 - DNA, 2083 bp, Homo sapiens
  Payload ID: 17316
  Gene Symbol: TACR2
  Gene Name: tachykinin receptor 2
  Uniprot ID: P21452
  ENST ID: ENST00000373306
  CDS Start-End: 545-1741
gcacccagcacccagcccggcttgcagcccaaagcctggagagaggctgctgcgccattgacctgtggactccagagactcccgctgtgcattcctctgatctggaaggtttcctgaattacgtgacgagaaacctgggttcgagtcctaacttgtcaccaacttcctgagtgacctgggctggtcccgtcccctcttggaatctctgtcttccatctcttcagcgaaggggttgatttataagggtgttttctgctctgacactgtgatttgaattctgtgtttccacatgatattcgagaagtctggccggaaggatggaatctgaaatgacaatggttctggactgggctttgtgctcagcccagctcatctttgcctgagacctaggagtggccccaggctctcctgatgtgccaccacgcttggcatctgctcctctccctgcccccatattcccatgctctgaaggggagttctctttcatagcaaatccgagaggagccgaggagccaggtcctttgttccagacccagaagcagccatggggacctgtgacattgtgactgaagccaatatctcatctggccctgagagcaacaccacgggcatcacagccttctccatgcccagctggcaactggcactgtgggccacagcctacctggccctggtgctggtggccgtgacgggtaatgccatcgtcatctggatcatcctggcccatcggaggatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctgcgccacctgcaggccatgaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctggattccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttgatcccaatgtggcagtgttgggaggtaggggttagtgggaggtgtttgggtattggggatggatcccttatgaatagattaatgccttccagttgaagtgaatcatcactcttgtgggaatggactagttcccaaaataacaagttgttagaaagagtgtggtgtcctcagtttccctgtcttgcttcctctctcaccatgtgatctctttgcacacaacacttcccttccactttccaccatgacaagaagcagcctgaggccttcaccagatgcagctgcccaatcttggatattccagccaccagaatcatgagccaaataaacctcttttctttataaa

SEQ ID NO: 188956 - DNA, 1740 bp, Homo sapiens
  Payload ID: 17316
  Gene Symbol: TACR2
  Gene Name: tachykinin receptor 2
  ENST ID: ENST00000373307
  CDS Start-End: 257-817
ccttttgcagggaagccgtctcctggcacacaggctacccaatgccacctttatttttgtttaaatcaaaccaagtccctgggaggcgcccagggtgggcccgcaggggcggctccacagtgcccgcggggtcccaggaccaggcgctggcagacttcggagtcgcccccgggccctccgctgcccaggcctcggctctccctgcaggtaccacctcgtggtgatcgccctcatctacttcctgccgctcgcggtgatgtttgtagcctacagcgtcatcggcctcacgctctggaggcgcgcagtgcccggacatcaggcgcacggtgccaacctgcgccacctgcaggccatgaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctggattccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttgatcccaatgtggcagtgttgggaggtaggggttagtgggaggtgtttgggtattggggatggatcccttatgaatagattaatgccttccagttgaagtgaatcatcactcttgtgggaatggactagttcccaaaataacaagttgttagaaagagtgtggtgtcctcagtttccctgtcttgcttcctctctcaccatgtgatctctttgcacacaacacttcccttccactttccaccatgacaagaagcagcctgaggccttcaccagatgcagctgcccaatcttggatattccagccaccagaatcatgagccaaataaacctcttttctttataaattacctagtctcaggtattccatgaaagcaacacaaatggactgagataggtgcctattgaaccctgaagccttgtgcctggctgcagaatgaggtgtagcaccctttgagaagtagccaatcgagaagaccacatctgaaagttcagctcatgccccatccttcagtataccaatacaaagacaacatggggccagaactccagaaaggatgctgactttaagaggactcagccacccatctcagagagcacttcagaggatccagtaagggtcagaaaagacagtgtaagctgatatttatctaatttaagagatgcaagctcaaatgccttcctggggcatacaagaatatgtataaaagaaaaactgcaaatgtgatgataaaaggcaactgacttccaccctcagtttgagctaatagggaatggtgggggccatggcaacctggagaggacaggcattcaaaggggacaagaactactcagctctggacaaacgttgccacatgataatgggagcccactgttgctagatcttctaaatctttcaagagaagctataaatccacatttgtatgtg

SEQ ID NO: 188957 - DNA, 1713 bp, Homo sapiens
  Payload ID: 17316
  Gene Symbol: TACR2
  Gene Name: tachykinin receptor 2
  ENST ID: ENST00000619173
  CDS Start-End: 1-1089
atggggacctgtgacattgtgactgaagccaatatctcatctggccctgagagcaacaccacgggcatcacagccttctcgatgcgcacagtcaccaactacttcatcgtcaatctggcgctggctgacctctgcatggctgccttcaatgccgccttcaactttgtctatgccagccacaacatctggtactttggccgtgccttctgctacttccagaacctcttccccatcacagccatgtttgtcagcatctactccatgaccgccattgctgccgacaggtacatggccatcgtccaccccttccagcctcggctttcagctcccagcaccaaggcggttattgctggcatctggctggtggctctcgccctggcctcccctcagtgcttctactccaccgtcaccatggaccagggtgccaccaagtgcgtggtggcctggcccgaagacagcgggggcaagacgctcctcctgtaccacctcgtggtgatcgccctcatctacttcctgccgctcgcggtgatgtttgtagcctacagcgtcatcggcctcacgctctggaggcgcgcagtgcccggacatcaggcgcacggtgccaacctgcgccacctgcaggccatgaagaagtttgtgaagaccatggtgctggtggtgctgacgtttgccatctgctggctgccctaccacctctacttcatcctgggcagcttccaggaggacatctactgccacaagttcatccagcaagtctacctggcactcttctggttggccatgagctctaccatgtacaatcccatcatctactgctgtctcaaccacaggtttcgctctggattccggcttgccttccgctgctgcccatgggtcacacccaccaaggaagataagctcgagctgactcccacgacctccctctccacgagagtcaacaggtgtcacactaaggagactttgttcatggctggggacacagccccctccgaggctaccagtggggaggcggggcgtccccaggatggatcagggctatggtttgggtatggtttgcttgcccccaccaaaactcatgttgaaatttgatcccaatgtggcagtgttgggaggtaggggttagtgggaggtgtttgggtattggggatggatcccttatgaatagattaatgccttccagttgaagtgaatcatcactcttgtgggaatggactagttcccaaaataacaagttgttagaaagagtgtggtgtcctcagtttccctgtcttgcttcctctctcaccatgtgatctctttgcacacaacacttcccttccactttccaccatgacaagaagcagcctgaggccttcaccagatgcagctgcccaatcttggatattccagccaccagaatcatgagccaaataaacctcttttctttataaattacctagtctcaggtattccatgaaagcaacacaaatggactgagataggtgcctattgaaccctgaagccttgtgcctggctgcagaatgaggtgtagcaccctttgagaagtagccaatcgagaagaccacatctgaaagttcagctcatgccccatccttcagtataccaatacaaagacaacatggggccagaactccagaaaggatgctgactttaagaggactcagccacccatctcagagagcacttcagaggatccagtaagggtcagaaaag

SEQ ID NO: 188958 - DNA, 5190 bp, Homo sapiens
  Payload ID: 17317
  Gene Symbol: TACR3
  Gene Name: tachykinin receptor 3
  Uniprot ID: P29371
  ENST ID: ENST00000304883
  CDS Start-End: 142-1539
attgcagtatctttcagcttccagtcttatctgaagactccggcaccaaagtgaccaggaggcagagaagaacttcagaggagtctcgtcttgggctgcccgtgggtgagtgggagggtccgggactgcagaccggtggcgatggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttaccagtcctgtcctatataccctctagaaacagaaagcaatttttaggcagctatggtcaaattgagaaaggtagtgtataaatgtgacaaagacactaataacatgttagcctccacccaaaataaaatgggctttaaatttattctttgaaaactctaaattattatatgcaatgaacaaaaatatgtcaggaaaatacttgtaaactcgccagtctatctcatttacaaattgcaatatacatttgtgacattaaaatgatatatagtttttccaagagattaaagaatctttaaaacataatattgtaagtgaagggaaacaaaatctgtataaaatctgtataaaataggcttttttgcctagagatataaaatgggaaaaaaagttaaatgattcattttcccactagagtaatggaaaattaacctcaagaagtaggaactgaaaatctttgctcaagaaaactcattttgtagaatgtaaagatttaaagatttaaagatttcttccatggcatttaactgaaaaggaaatctagttaaatcattaggcaaatgtatatttcattctcttgattttttttctgagaaagtgaaattttaaaaaattatatactttttgaccattacttatttttgaataccaagctaaaaagtagtcagttaagaccctaaaaatatgaagaaaattcctatcattttttatttttcacagattttttaaatagctagattataaaacagtaaaggtacattccaataaatagaggaagaatactatttatgttctcttcctctcccctcactgaaaatagaataaggactaggagaaaatatcttcaaaggcaactccttagggaaaaaaagtcacaagtgtgacaaaagactatatggttgaaaaataccaatatatgttacatatgagtaaactaggcaaggtgtagacaagtgaattacctcttagaaaacgaatctgcacaatagtttggatacatgtaaactaataacagctgagcaagagggtgagtttaacacacatccttccacagaaagaccttttctttcatttgcttagattattcagaagtcttaccagaaagaaatgagataatagtcctaagaaagcatcacatttactacaagaagatatatactagcacatttctgagactcataacataacaagaaatacttttaagtgtaaaaagtaacatccaggcctcagtgcttacagatcatctttccttgaattagggatactgttaatcctgctcaagaaagcagaaactttttgagaatgtgaatgtgtagtacaaacttctcctttaaactcttcagtttgatttttaaagatatttgtctaaaataatactctctaacaaacactttactgttgtgcctccaccgatattaaaacaaaatatttttgaagaacagaataaaagcaaatattcaatggcaaatcatggtctatttctcaaatctcttccctattttgaagccaaaaccagaaatatccaattgttacaaaaagttcggagtctaaacaagctaaacatatgtgttccagctgaatttcttctgatgataccaataaacaaagagacacacacacacacacacacacatacaaatgtgcctacacattcaatcatttaatgaatgcaacaacttcaaagaattaaaatcaaatactgaaatgataagtggtcattacagcattgccatatgctcaataaagtctgtgaagcttgtgtgcatgttttaaataagcaaatttaatatatagtatctaattgtttgaatataatgtttttgaatgttcattcttaaaacatatatttatcatacaatgttaaagtgtcaagaaaaagcctaatatgtaaaaagttattattttcttaaatttatgaatgatatggtactagcattaattaatgttttagacatatggaaccatattcagctgtaaaatatgaatatgaagtttagccctcaaatttaatgtcatcagccactaccaaagtatcatacatttgaaaaatataactcctggccctcacatattagagaaattcagtagaattttctaagacatttatttctaaggaaaaatactggcctcgtcagttggattgttggtttgctttggcttctgtgaacatacatattgttgtgttgcttaccgagcacctcccttctagtgtgacagaaatacccagacagtattttttcaatgctttccagaaaaaaactggcatcattcactcactactcatggcccttaaactgagacctataggcagaattttttaagttcaaaaatttaaacgacaataataaaacaagagtgaaatataaaagagaagatttttcactcttttgtctgcattttgacaataagaattacagaataatgcacaaaatcaaattcagtgagattcatttttaaataaagtcatcccagtgttttcatatttgctaagcttggaaagaatctgccttcaaaatttactctaccctctgtttctaaagttcagtatgaatctttccattgtttgaaggcaaacactggctcagactactaggcagatggttaaaacagcccaggtttttttacttagatcagtatcagaaaaattcaaaatatttttaaacaaatatgaaagaatcaaaaaggcttacatcattgtaagtattctcttttaaacaaaatacattaaatcaaaaataaacattgcttactattttgcatctggacaaagtacaagatattgaaattacctgtatgggaaaatattaaagcggacataattgttacagaattcactctcacacttttttattttttaccaagtacagcacactgttgcattattccatcttctaacttcatgatggtgacatttctgacccagcagctgaattcatgtccttttccaaatcctgccaatgtcttagaaacagtgaactgagcaatttcagagtgaaccccgcccttacaaagcacataaagaataccaagaagcttggtatcaagcctatgaaatacaaaataaatgtgaaaaataaatgctggccagctcaacatttgaatttagtttttgcaaatgcaaaatttcctctaaaaatttatgattagtacctggtaaactatttcatcaaatagaaaagcaggagacttacaaacatttctcacacttctaacagtaacaatttcctacttatcattgataatatgtcaaaagctaaggaaatccagaatgacatggaccatgtagaacaataaggttggaataatttcccttagggccaagcaggaatagagaataaagttcagaagggctgtacaaggtcattagttttgtgttttcatacatatatatatatatatgaaaaatctgtttatataagaagtaaatgtatataaagtttgtagtgaataaagtattttcaagttgtggtaattatattgaatatgtttaatgtatttacaccctttgcatatgtgataatgtgacagatttaatttctattttttctttaaaaacattaaaactaatattaaaagtaaaa

SEQ ID NO: 188959 - DNA, 1011 bp, Homo sapiens
  Payload ID: 17318
  Gene Symbol: TAC1
  Gene Name: tachykinin, precursor 1
  Uniprot ID: P20366
  ENST ID: ENST00000346867
  CDS Start-End: 122-466
aaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaata

SEQ ID NO: 188960 - DNA, 975 bp, Homo sapiens
  Payload ID: 17318
  Gene Symbol: TAC1
  Gene Name: tachykinin, precursor 1
  Uniprot ID: P20366
  ENST ID: ENST00000350485
  CDS Start-End: 122-457
aaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaatggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatag

SEQ ID NO: 188961 - DNA, 1239 bp, Homo sapiens
  Payload ID: 17318
  Gene Symbol: TAC1
  Gene Name: tachykinin, precursor 1
  Uniprot ID: P20366
  ENST ID: ENST00000319273
  CDS Start-End: 298-687
gggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaa

SEQ ID NO: 188962 - DNA, 6216 bp, Homo sapiens
  Payload ID: 17319
  Gene Symbol: TAF1L
  Gene Name: TAF1 RNA polymerase II, TATA box binding protein (TBP)-associated factor, 210kDa-like
  Uniprot ID: Q8IZX4
  ENST ID: ENST00000242310
  CDS Start-End: 91-5571
ccccgcctttattcagcttccggtagacgctggtagggtaagggagctaagtagatcacttccgggcgactgttgttttatttccggtttatgcgacccggctgcgatttgctgctgagggcagcagctaccgtcactgccgccatcatgtcagactcggacagcgaggaagattcatctggaggtggcccatttactttagcgggtatccttttcggcaacatcagtggagcggggcagctggagggggaaagcgtcttggatgatgagtgtaagaagcacttggcaggcttgggggctttggggctgggcagcctaatcactgaactcacggcaaatgaagaattgactgggactggcggtgccttggtaaatgatgaagggtggattaggagtacagaagatgctgtagactattcagacatcaatgaggtggcagaagatgaaagccaaagacaccagcagacgatggggagcttgcagcccctttaccactcggattatgatgaagatgactatgatgctgattgtgaagacattgattgcaagttgatgcctcctccacctccacccccgggaccaatgaagaaggataaggaccaagatgctattacctgtgtgtctgaaagtggagaagacatcatcttgccctccatcattgccccttcctttttggcctcagagaaagtggatttcagtagttactctgattcagaatctgagatgggacctcaggaagcaacacaggcagaatctgaggatggaaagctgacccttccattggctgggattatgcagcatgatgccaccaagctgttgccaagtgtcaccgaactttttccagaatttcgacctggaaaagtgttacgcttcctacatctttttggaccagggaagaatgtcccatctgtttggcggagtgctcggagaaagaggaagaagcatcgtgagctgatacaggaagagcagatccaggaggtggaatgctcagtagaatcagaagtcagccagaagtctttgtggaactatgactatgctccaccaccacccccagagcagtgtctcgctgatgatgaaatcacgatgatggttcctgtggagtccaaattttcccaatcaactggagatgtagataaagtgacagataccaaaccaagagtggctgagtggcgttatgggcctgcccgactgtggtatgatatgctgggtgtctccgaagatggcagtgggtttgactatggcttcaaactgagaaagacacaacatgaacctgtgataaaatctagaatgatggaggaatttaggaaacttgaggaaagcaatggcactgatcttctggctgacgaaaacttcctgatggtgacacagctgcattgggaggattctatcatctgggatggggaggatatcaaacacaaagggacaaaacctcagggtgcaagcctggcaggctggcttccttctattaagactaggaatgtaatggcttacaatgttcagcaaggttttgcacccactctggatgatgacaaaccttggtactccatttttcccattgacaatgaggatctggtgtatggacgctgggaggacaatatcatttgggatgctcaggccatgccccggctgttggaacctcctgttttggcacttgatcccaatgatgagaacctcattttggaaattcctgatgagaaggaagaggccacctctaactccccctccaaggagagtaagaaggaatcatctctgaagaagagtcgaattctcttgggcaaaacaggtgtcatcagggaggaaccacagcagaacatgtctcagccagaagtgaaagatccatggaatctctccaatgatgagtattatttccccaagcaacagggtcttcggggcacctttggagggaatattatccagcattcaattcctgctatggaattatggcagcccttctttcccacccacatggggcccatcaaaatccggcagttccatcgcccacctctgaaaaagtactcatttggtgcactctctcagccaggtccccattcagtccaacctttgctaaagcacatcaaaaaaaaggccaagatgagagaacaagagaggcaagcctcaggtggtggagagttgttttttatgcgcacacctcaggatctcacaggcaaagatggagatcttattcttgcagaatatagtgaggaaaatggacccttaatgatgcaggttggcatggcaaccaagataaagaactattataaacggaaacctggcaaagatcctggagcaccagattgtaaatatggggaaactgtttactgccatacatctcctttcttgggctctctccatcctggccaattactgcaggcacttgagaacaacctttttcgtgctccagtgtatcttcataagatgccagaaactgattttctgatcattcggacaagacagggttactatattcgggaattagtggatatttttgtggttggccagcagtgtcccttgtttgaagttcctgggcctaactccagaagggccaatatgcatattcgagactttctacaggtttttatttaccgccttttctggaagagtaaagatcggccacggaggatacgaatggaagatataaaaaaagcctttccttcccattcagaaagcagcatccggaagaggctaaagctctgcgctgacttcaaacgcacagggatggattcaaactggtgggtgcttaagtctgattttcgtttaccaacggaagaagagatcagagctaaggtgtcaccagagcagtgctgtgcttattatagcatgatagctgcaaagcaacgactgaaggatgctggctatggtgagaaatccttttttgccccagaagaagaaaatgaggaagatttccagatgaagattgatgatgaagttcacgctgctccttggaacaccacaagggccttcattgctgccatgaagggcaagtgtctcctagaggtgactggggtggcagatcccacagggtgtggtgaaggattctcctatgtgaagattccaaataaaccaacacagcagaaggatgataaagagccacaggcagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcattctggagaggggcccatgagtaaatttgcccgtggatcaaggttttctgtggctgagcatcaagagcgttacaaagaggaatgtcagcgtatctttgacctacagaacaaggttctgtcatcaactgaggtcttatcaactgacacagacagcatctcagctgaagatagtgactttgaagaaatgggaaagaacattgagaacatgttgcagaacaagaaaaccagctctcagctgtcacgtgaatgggaggagcaggagcggaaggaactacggcgaatgctactggtagcaggctcagcagcatcaggaaacaatcacagagatgatgtcacagcttccatgactagccttaagtcttctgccactggacactgtctcaagatttatcgcacatttcgagatgaagaggggaaagagtatgttcgctgtgagacagtccgaaaaccagctgtcattgatgcctatgtgcgcatacggactacaaaagatgagaaattcattcaaaaatttgccctttttgatgaaaaacatcgggaagagatgcggaaagaacggcggaggattcaagagcaactgaggcggcttaagcggaaccaggaaaaggagaagcttaagggtcctcctgagaagaagcccaagaaaatgaaagagcgtcctgacctaaaactgaaatgtggggcatgtggtgccattggacatatgaggactaacaaattctgccccctctattatcaaacaaatgtgccaccttcgaaacctgttgccatgacagaagagcaggaggaggagttggaaaagacagtcattcataatgataatgaagaacttatcaaggttgaagggaccaaaattgtcttcgggaaacagctaattgagaatgtgcatgaggttcgcagaaaatctctggttctcaagtttcctaaacagcagcttcctccaaagaagaaacggcgagttggaaccactgttcattgtgactatttgaatatacctcataagtccatccaccgacgccgcacagaccctatggtgacgctgtcatccatcctggagtctatcatcaatgacatgagagatcttccaaatacacaccctttccacactccagtcaatgcaaaggttgtaaaggactactacaaaatcatcactcggccaatggacctacaaacactccgtgaaaatgtgcgtaaatgcctctacccatctcgggaagagttcagagagcatctggagctaattgtgaaaaacagtgcgacctacaatgggccaaaacattcattgactcagatctctcaatccatgctggatctctgtgatgaaaaacttaaagagaaagaagacaaattagctcgcttagagaaagctatcaaccccttgctggatgatgatgaccaagtggcattttctttcattctggacaacattgtcacccagaaaatgatggcagttccagattcttggccatttcatcacccagttaataagaagtttgttccagattattacaaaatgattgtcaatccagtggatttagagaccatacgtaagaacatctccaagcacaagtatcagagtcgggagagttttctagatgatgtaaaccttattcttgccaacagtgttaagtataatggacctgagagtcagtacactaagactgctcaggagattgtgaacatctgttaccagacaattactgagtatgatgagcatttgactcaacttgagaaggatatttgtacagctaaagaagcagctttggaggaagcagaattagaaagcctggacccaatgaccccagggccctacacatctcagcctcctgatatgtatgataccaacacatccctcagtacgtctcgagatgcctctgtatttcaagatgagagcaatttgtctgtcttggatatttccactgccactccagaaaaacagatgtgccagggccaaggtaggctgggtgaggaagactctgatgtggatgttgaagggtatgatgatgaggaggaggatgggaaacctaagcctccagccccagaagggggagatggtgatcttgcagatgaagaggaaggaactgtacaacaacctgaagccagtgtcctgtatgaggatttgcttatatctgaaggagaagatgatgaggaagatgctgggagtgacgaagaaggagacaatcctttctctgctatccagctgagtgaaagtggaagtgactctgatgtgggatatggtggaataagacccaaacaacccttcatgcttcagcatgcttcaggagaacacaaggatgggcacggaaaatgaagaaagcatgatgtcccatgagggagacggtggggaggcttcccatgatttggaggatagcaacatcagttatgggagctgtgaggagcctgatcccaagttgaacacccaagacacaagcttcagcagcatcggaaatttccagctgggcatggtggctcacacctgtaatctcagcactctgggaggccgaggcgggtggatcacctgaggtcagttcgagaccagcttggccaacatgtcgaaacttcatctctactaaaaatacaaaaattagccaggtgtggtggtgcacgcctgtaatccccagatactcgggaggctgaagcaggagaattgcttgaacccgggaggcagaggttgcagtgagtggagatcacgccactgcgctccagcctgggcgaaagagtgagactccatctcaaaaaaaaagaaaatttccaagcatggtatcatctcacttttctaatttacaggctggaacagatgagagccctcctgctgggacagagaattgggttctagtggactctgctacacttaaacctatgtgacaaaccgcccattattttattgtttatttaattatacaatgcctcgttcctatatggatttgaggcaaattaccataaattttgaaacagc

SEQ ID NO: 188963 - DNA, 5692 bp, Homo sapiens
  Payload ID: 17320
  Gene Symbol: TAF1
  Gene Name: TAF1 RNA polymerase II, TATA box binding protein (TBP)-associated factor, 250kDa
  Uniprot ID: P21675
  ENST ID: ENST00000276072
  CDS Start-End: 11-5692
tttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatga

SEQ ID NO: 188964 - DNA, 2199 bp, Homo sapiens
  Payload ID: 17320
  Gene Symbol: TAF1
  Gene Name: TAF1 RNA polymerase II, TATA box binding protein (TBP)-associated factor, 250kDa
  ENST ID: ENST00000373775
  CDS Start-End: 1-1376
ctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcaggctaagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcaggtaccaatgaacaagccattcagagatggatccacaaagatctctggagcaacgaccaggtcctgctctacccgattctcagctttggggatagaattcccagaaacatctgtgtccggagttggttccttccagtgggttcttggtcttgctgacttcaagaatgaagccgtggaccttcgcgcttcaggctgaagatagtgaaaatccgtgccagacttggattggaagaatgaaccaaggctttgagtctcttcgtctcatctccgttttgatacgtgtctccttagtttgtaagccaaggagaggactacagtgaggattgtggagggaagtggaccttattggtctttgagctctcacatctttaaagactgttggtgctgagagaaaaagtatcctcatctggcagaactcccatagggtgtgctccccttgctgttctgcttttgttttgcagaaagctgcctttttcaatgtactcattaggctttcattgttttttccttttttacctttttcatctttcactgttgatatcacaggtggccatatctttaccagtgcagctaccaaataagaaatcatcttttccacattcactagttagtgatggttgttgtactaccatgaaatcagtttcttctttacttttattcaggttacaagatttctggaaggttttaagatcaattttaattagtctttgtgactggttacttcatccaggggaccaatttctctctggaatattagtcccgcacccctggagagcctgtgcggctgcatctccctccggaggtggttctggagttggttccttttggtgggtt

SEQ ID NO: 188965 - DNA, 7629 bp, Homo sapiens
  Payload ID: 17320
  Gene Symbol: TAF1
  Gene Name: TAF1 RNA polymerase II, TATA box binding protein (TBP)-associated factor, 250kDa
  Uniprot ID: P21675
  ENST ID: ENST00000373790
  CDS Start-End: 52-5670
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattcca

SEQ ID NO: 188966 - DNA, 2295 bp, Homo sapiens
  Payload ID: 17320
  Gene Symbol: TAF1
  Gene Name: TAF1 RNA polymerase II, TATA box binding protein (TBP)-associated factor, 250kDa
  ENST ID: ENST00000437147
  CDS Start-End: 1-1472
ctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacagatgcgccagggccgaggtaggctgggcgaggaagactctgatgtagatattgaagggtatgatgatgaggaggaggatgggaaacctaagactccagccccagaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcaggtaccaatgaacaagccattcagagatggatccacaaagatctctggagcaacgaccaggtcctgctctacccgattctcagctttggggatagaattcccagaaacatctgtgtccggagttggttccttccagtgggttcttggtcttgctgacttcaagaatgaagccgtggaccttcgcgcttcaggctgaagatagtgaaaatccgtgccagacttggattggaagaatgaaccaaggctttgagtctcttcgtctcatctccgttttgatacgtgtctccttagtttgtaagccaaggagaggactacagtgaggattgtggagggaagtggaccttattggtctttgagctctcacatctttaaagactgttggtgctgagagaaaaagtatcctcatctggcagaactcccatagggtgtgctccccttgctgttctgcttttgttttgcagaaagctgcctttttcaatgtactcattaggctttcattgttttttccttttttacctttttcatctttcactgttgatatcacaggtggccatatctttaccagtgcagctaccaaataagaaatcatcttttccacattcactagttagtgatggttgttgtactaccatgaaatcagtttcttctttacttttattcaggttacaagatttctggaaggttttaagatcaattttaattagtctttgtgactggttacttcatccaggggaccaatttctctctggaatattagtcccgcacccctggagagcctgtgcggctgcatctccctccggaggtggttctggagttggttccttttggtgggtt

SEQ ID NO: 188967 - DNA, 7722 bp, Homo sapiens
  Payload ID: 17320
  Gene Symbol: TAF1
  Gene Name: TAF1 RNA polymerase II, TATA box binding protein (TBP)-associated factor, 250kDa
  Uniprot ID: P21675
  ENST ID: ENST00000423759
  CDS Start-End: 77-5764
agcttccggtagaggctggtagggtaagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcaggctaagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattcc

SEQ ID NO: 188968 - DNA, 498 bp, Homo sapiens
  Payload ID: 17320
  Gene Symbol: TAF1
  Gene Name: TAF1 RNA polymerase II, TATA box binding protein (TBP)-associated factor, 250kDa
  ENST ID: ENST00000463163
  CDS Start-End: 1-452
aggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatggaataggcataaggatcaaacacacaaggtcgatagaaaaggggcacagtcatcaccaccttcctcgagaatagccttctttgactttcctgatctggataaatgtatttcccctctgaa

SEQ ID NO: 188969 - DNA, 836 bp, Homo sapiens
  Payload ID: 17320
  Gene Symbol: TAF1
  Gene Name: TAF1 RNA polymerase II, TATA box binding protein (TBP)-associated factor, 250kDa
  ENST ID: ENST00000483985
  CDS Start-End: 1-836
gcagctcagctgaagatagtgactttgaagaaatgggaaagaacattgagaacatgttgcagaacaagaaaaccagctctcagctttcacgtgaacgggaggaacaggagcggaaggaactacagcgaatgctactggcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaat

SEQ ID NO: 188970 - DNA, 1215 bp, Homo sapiens
  Payload ID: 17321
  Gene Symbol: TAF10
  Gene Name: TAF10 RNA polymerase II, TATA box binding protein (TBP)-associated factor, 30kDa
  Uniprot ID: Q12962
  ENST ID: ENST00000299424
  CDS Start-End: 479-1135
ccccacctctcggggcagctggcggagaagagagggggctttccaaatccactatgaatccttaaaaggctgaataagggaacttgaaacgatgcagacaggcaggcaacccgtagtcgagggacatagggccataaacgtcgaagccaggtcttgagcgtcagacagaatgaggtgtcccagagcggcggaggagagccagacgcacgctggttccggtctggacggaatcgccgcggagcacggcagaggctagggcggaatggctacggcagcgcagttcgccaaggctcggtctccgccctgcagcctatttcctctaacccgcagatccactatgggaggaggcggggagcgggctggagagcactaacagagacaggcggggcgagtcgtgggcgcgtgacgtcaccccggggtgtgcgcggcgcgagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggc

SEQ ID NO: 188971 - DNA, 425 bp, Homo sapiens
  Payload ID: 17321
  Gene Symbol: TAF10
  Gene Name: TAF10 RNA polymerase II, TATA box binding protein (TBP)-associated factor, 30kDa
  ENST ID: ENST00000527248
  CDS Start-End: 1-348
gccgcctcggccccgggccccgcgcccccggtctcggctcccgccgcgctgccctccagcaccgccgcggagaacaagatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgaca

SEQ ID NO: 188972 - DNA, 1580 bp, Homo sapiens
  Payload ID: 17322
  Gene Symbol: TAF11
  Gene Name: TAF11 RNA polymerase II, TATA box binding protein (TBP)-associated factor, 28kDa
  Uniprot ID: Q15544
  ENST ID: ENST00000361288
  CDS Start-End: 133-768
caggagagcggtaggggtgatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 188973 - DNA, 1465 bp, Homo sapiens
  Payload ID: 17322
  Gene Symbol: TAF11
  Gene Name: TAF11 RNA polymerase II, TATA box binding protein (TBP)-associated factor, 28kDa
  Uniprot ID: Q15544
  ENST ID: ENST00000420584
  CDS Start-End: 115-579
gatgtcatcgctgcgcgacgacaggaagtaagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgc

SEQ ID NO: 188974 - DNA, 1359 bp, Homo sapiens
  Payload ID: 17323
  Gene Symbol: TAF12
  Gene Name: TAF12 RNA polymerase II, TATA box binding protein (TBP)-associated factor, 20kDa
  Uniprot ID: Q16514
  ENST ID: ENST00000263974
  CDS Start-End: 436-921
agacgctgctgcctgtgagtcttgggccctggcagttgaggaacaagagcgggaggagggagtcaggacccagacctacagtgggtcagtgttcgaaggaccaggttgtggacgagacggggctgtgaggattcaggctcttgggaagggactgactgagaggatcaggctcggagaagacgcggctgtggggacccgggctctaagacgggacttagggaacggggacggatgcgagttctccggcatctgagggaaagtggtctgagaggagcaggattatgaggacccgcactcctacgaggaaagggtcagaaaggaacggggcgtgaagacacaggctccggagagttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaat

SEQ ID NO: 188975 - DNA, 1334 bp, Homo sapiens
  Payload ID: 17323
  Gene Symbol: TAF12
  Gene Name: TAF12 RNA polymerase II, TATA box binding protein (TBP)-associated factor, 20kDa
  Uniprot ID: Q16514
  ENST ID: ENST00000373824
  CDS Start-End: 160-645
gtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaagacagggtacctttgaaatcccagagggagtcaggacaagcaagcctggattgtagctctctagtcagcaggtggcagcatcgttattcattttggtgtttgagaaaaactcagggattttccatcattttaccccaagggaggccataacatcagcaggagtttgagtccagcttctcggccataagaattgagtagggtgaccttctctcacggccctcaactgaagaggcatccttgttttgg

SEQ ID NO: 188976 - DNA, 813 bp, Homo sapiens
  Payload ID: 17324
  Gene Symbol: TAF13
  Gene Name: TAF13 RNA polymerase II, TATA box binding protein (TBP)-associated factor, 18kDa
  Uniprot ID: Q15543
  ENST ID: ENST00000338366
  CDS Start-End: 56-430
gtgtaaccagctgggagccagccggcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgattttagggtgatattggtgcatgtaattgcctgcctttatattaccatacttgaattacttactgggttttaatgaccacacataagtcaaagtaccttgcaaaccatgccgttgttctgacttttgactatttaaaggataaagtagtatttaatgtgttaggtatgtttatgcccttgtaagctatactgtagctttttttttttttttttttttttttgagatggagtctcacta

SEQ ID NO: 188977 - DNA, 1076 bp, Homo sapiens
  Payload ID: 17324
  Gene Symbol: TAF13
  Gene Name: TAF13 RNA polymerase II, TATA box binding protein (TBP)-associated factor, 18kDa
  Uniprot ID: Q15543
  ENST ID: ENST00000461096
  CDS Start-End: 25-399
gctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatatcgcaccactgcactccagcctgggcgacagagcgagactccgtctcaaaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaa

SEQ ID NO: 188978 - DNA, 656 bp, Homo sapiens
  Payload ID: 17325
  Gene Symbol: TAF15
  Gene Name: TAF15 RNA polymerase II, TATA box binding protein (TBP)-associated factor, 68kDa
  ENST ID: ENST00000603967
  CDS Start-End: 1-309
agtggaggctatggaggagacaggagtggtggcggctatggaggagaccgaggtgggggctacggaggagaccgaggtggctatggaggcaaaatgggaggaagatccagctgctcttcgaagaggccaaggacatgggatgggtcatgctgcacagtggtggctgtgtccttactggatctgacccgccatcctagcaccccggggagcctcgtctgtgcccacatgccacacatctcagaccctgtttccttctttcctgaactccagcagttctcagactcaccacctgctgtagtgcctccatgacaaacttgtcactgatgcgtaagcatcccagagcctgcaggaagagggatggaggaaagagaaggaaacttggacatcatccccaggagttaccattctctggatacagctggagtttgtgcttggaataccatccccacaaccaccatcacgtcaagcagctttttactttccagcttggccaactcctggctgtaaccaccctcctctatccttgcctcttctcacctgtgctgcatagaactgctcatcctctctgggagattccaggctttttgtgagttcctgcccatccaaggcagccagtggaaaggaagacagagaaaaataaagaatttcaaactaaa

SEQ ID NO: 188979 - DNA, 2191 bp, Homo sapiens
  Payload ID: 17325
  Gene Symbol: TAF15
  Gene Name: TAF15 RNA polymerase II, TATA box binding protein (TBP)-associated factor, 68kDa
  Uniprot ID: Q92804
  ENST ID: ENST00000605844
  CDS Start-End: 116-1894
agtccgcctcagcccgccgcgccgccctcagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggacttttgta

SEQ ID NO: 188980 - DNA, 547 bp, Homo sapiens
  Payload ID: 17325
  Gene Symbol: TAF15
  Gene Name: TAF15 RNA polymerase II, TATA box binding protein (TBP)-associated factor, 68kDa
  ENST ID: ENST00000603427
  CDS Start-End: 452-547
agtacagctccggccgccgcgccgcctggctttcgtattcgttgttctcggcgggctgtggggcctccgcgccgcggccgttagtcatgtcggcgaggcctcgggccagtcatctcgccgcctcgtacctcagttttcccatcctcgaagtggagctgggcctgcctgactcacccattcatcagattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgat

SEQ ID NO: 188981 - DNA, 2011 bp, Homo sapiens
  Payload ID: 17325
  Gene Symbol: TAF15
  Gene Name: TAF15 RNA polymerase II, TATA box binding protein (TBP)-associated factor, 68kDa
  ENST ID: ENST00000603777
  CDS Start-End: 530-1879
agtacagctccggccgccgcgccgcctggctttcgtattcgttgttctcggcgggctgtggggcctccgcgccgcggccgttagtcatgtcggcgaggcctcgggccagtcatctcgccgcctcgtacctcagttttcccatcctcgaagtggagctgggcctgcctgactcacccattcatcagcaagtctttggaaatatttttgttggtgctgacagccaaagcagtccaatacagaggaatggtgtatatcttggggtgattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaaccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtgga

SEQ ID NO: 188982 - DNA, 2140 bp, Homo sapiens
  Payload ID: 17325
  Gene Symbol: TAF15
  Gene Name: TAF15 RNA polymerase II, TATA box binding protein (TBP)-associated factor, 68kDa
  Uniprot ID: Q92804
  ENST ID: ENST00000604841
  CDS Start-End: 82-1851
agctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtgga

SEQ ID NO: 188983 - DNA, 1214 bp, Homo sapiens
  Payload ID: 17325
  Gene Symbol: TAF15
  Gene Name: TAF15 RNA polymerase II, TATA box binding protein (TBP)-associated factor, 68kDa
  ENST ID: ENST00000603393
  CDS Start-End: 400-765
agtacagctccggccgccgcgccgcctggctttcgtattcgttgttctcggcgggctgtggggcctccgcgccgcggccgttagtcatgtcgggtaggtgacttcttcagcgagcagcggcagcgacgagaagattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagtcagtcaggttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaaggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaatt

SEQ ID NO: 188984 - DNA, 808 bp, Homo sapiens
  Payload ID: 17325
  Gene Symbol: TAF15
  Gene Name: TAF15 RNA polymerase II, TATA box binding protein (TBP)-associated factor, 68kDa
  ENST ID: ENST00000604879
  CDS Start-End: 90-808
ctcagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttgggga

SEQ ID NO: 188985 - DNA, 891 bp, Homo sapiens
  Payload ID: 17325
  Gene Symbol: TAF15
  Gene Name: TAF15 RNA polymerase II, TATA box binding protein (TBP)-associated factor, 68kDa
  ENST ID: ENST00000604694
  CDS Start-End: 1-644
gccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaa

SEQ ID NO: 188986 - DNA, 2191 bp, Homo sapiens; identical to SEQ ID NO: 188979
  Payload ID: 17325
  Gene Symbol: TAF15
  Gene Name: TAF15 RNA polymerase II, TATA box binding protein (TBP)-associated factor, 68kDa
  Uniprot ID: Q92804
  ENST ID: ENST00000617382
  CDS Start-End: 116-1894

SEQ ID NO: 188987 - DNA, 547 bp, Homo sapiens; identical to SEQ ID NO: 188980
  Payload ID: 17325
  Gene Symbol: TAF15
  Gene Name: TAF15 RNA polymerase II, TATA box binding protein (TBP)-associated factor, 68kDa
  ENST ID: ENST00000631553
  CDS Start-End: 452-547

SEQ ID NO: 188988 - DNA, 1214 bp, Homo sapiens; identical to SEQ ID NO: 188983
  Payload ID: 17325
  Gene Symbol: TAF15
  Gene Name: TAF15 RNA polymerase II, TATA box binding protein (TBP)-associated factor, 68kDa
  ENST ID: ENST00000631846
  CDS Start-End: 400-765

SEQ ID NO: 188989 - DNA, 656 bp, Homo sapiens; identical to SEQ ID NO: 188978
  Payload ID: 17325
  Gene Symbol: TAF15
  Gene Name: TAF15 RNA polymerase II, TATA box binding protein (TBP)-associated factor, 68kDa
  ENST ID: ENST00000633893
  CDS Start-End: 1-309

SEQ ID NO: 188990 - DNA, 891 bp, Homo sapiens; identical to SEQ ID NO: 188985
  Payload ID: 17325
  Gene Symbol: TAF15
  Gene Name: TAF15 RNA polymerase II, TATA box binding protein (TBP)-associated factor, 68kDa
  ENST ID: ENST00000633762
  CDS Start-End: 1-644

SEQ ID NO: 188991 - DNA, 808 bp, Homo sapiens; identical to SEQ ID NO: 188984
  Payload ID: 17325
  Gene Symbol: TAF15
  Gene Name: TAF15 RNA polymerase II, TATA box binding protein (TBP)-associated factor, 68kDa
  ENST ID: ENST00000631959
  CDS Start-End: 90-808

SEQ ID NO: 188992 - DNA, 2140 bp, Homo sapiens; identical to SEQ ID NO: 188982
  Payload ID: 17325
  Gene Symbol: TAF15
  Gene Name: TAF15 RNA polymerase II, TATA box binding protein (TBP)-associated factor, 68kDa
  Uniprot ID: Q92804
  ENST ID: ENST00000631482
  CDS Start-End: 82-1851

SEQ ID NO: 188993 - DNA, 2011 bp, Homo sapiens; identical to SEQ ID NO: 188981
  Payload ID: 17325
  Gene Symbol: TAF15
  Gene Name: TAF15 RNA polymerase II, TATA box binding protein (TBP)-associated factor, 68kDa
  ENST ID: ENST00000633578
  CDS Start-End: 530-1879

SEQ ID NO: 188994 - DNA, 5048 bp, Homo sapiens
  Payload ID: 17326
  Gene Symbol: TAF2
  Gene Name: TAF2 RNA polymerase II, TATA box binding protein (TBP)-associated factor, 150kDa
  Uniprot ID: Q6P1X5
  ENST ID: ENST00000378164
  CDS Start-End: 300-3899
acttccgctgacgtcggaggtcagaggttacagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacagtatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgatatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattcaatggtgagcacatggacaggaccaccagccatgaagtcactcttcactaggatgttttgttgtaaaagttgtccaaacattgtgaaaacaaacaactttatgagctttcaaagctattttctacagaagactatgccagttgcaatggctttattaagagatgttcataatctttgtcctaaagaagtcttaacatttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctttttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattcttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttg

SEQ ID NO: 188995 - DNA, 586 bp, Homo sapiens
  Payload ID: 17326
  Gene Symbol: TAF2
  Gene Name: TAF2 RNA polymerase II, TATA box binding protein (TBP)-associated factor, 150kDa
  ENST ID: ENST00000521007
  CDS Start-End: 271-453
acagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtggagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtctt

SEQ ID NO: 188996 - DNA, 569 bp, Homo sapiens
  Payload ID: 17326
  Gene Symbol: TAF2
  Gene Name: TAF2 RNA polymerase II, TATA box binding protein (TBP)-associated factor, 150kDa
  ENST ID: ENST00000523098
  CDS Start-End: 1-202
taatgaagttagaactttggataacttaaatcctgatgtgcgactcattcttgaagaaatcaccagatttttgaatatggaaaaacttcttccgagttacaggcataccatcactgtcaggctggagtgcagtggcgcaatcttggctcaccacaacctccacctcctgggttccagtgattctcctgcctcagcctcctgaatagctgggattacaggcatgcaccaccatgcctggctatttttgtattttcagtagagacggggtttcaccatgttagtcagttgtttgagagccatacgggtacttcagaagaacggacatgtgccaagtgatccagctctttttaaatcttatgctgaatatggccactttgtggacattaggatagcagctttggaagcagttgttgattatactaaaggtaatactttagaaatacgtgctcatatcattttagaaagaactatttactttttaaagccagtgttgttggggttttcgtaatatgtataacacagatattttaattttaaattcttgacttagtgatttagaaatcatcttt

SEQ ID NO: 188997 - DNA, 855 bp, Homo sapiens
  Payload ID: 17326
  Gene Symbol: TAF2
  Gene Name: TAF2 RNA polymerase II, TATA box binding protein (TBP)-associated factor, 150kDa
  ENST ID: ENST00000523904
  CDS Start-End: 1-855
tgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttaggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacagtatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgcc

SEQ ID NO: 188998 - DNA, 1237 bp, Homo sapiens
  Payload ID: 17326
  Gene Symbol: TAF2
  Gene Name: TAF2 RNA polymerase II, TATA box binding protein (TBP)-associated factor, 150kDa
  ENST ID: ENST00000529653
  CDS Start-End: 1-1128
tatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctgaagatgatcaccttgccaaggaagcatcatgtaatatatcagctcatcagcagggagtgaagaggaagtctgatacaccactggggtccccactagaacctggtcaaatactggagaagaatgaggatagcagtaaagtcaaactcaaaatcagattttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcc

SEQ ID NO: 188999 - DNA, 4872 bp, Homo sapiens
  Payload ID: 17327
  Gene Symbol: TAF3
  Gene Name: TAF3 RNA polymerase II, TATA box binding protein (TBP)-associated factor, 140kDa
  Uniprot ID: Q5VWG9
  ENST ID: ENST00000344293
  CDS Start-End: 207-2996
cagcgggaggcggagcgagtccaaaatggcggctctcaggctggcgcgctccgtgctgctggggctttgaggtggtcgccgggggtccgggggaccctttccccgccgcggaagccctagaggatgaatcggggaccctgctaaggtctggcggcggggctggagagcagtggcagcaagggctgcggtggcgtccacgcagcgggatgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggaggtaaagaagaagttgaaaaaggaactaaagactaaaatgaaaaagaaagaaaagcagagagatagggagagggaaaaagacaagaacaaggacaaaagtaaggagaaggataaagtgaaagagaaagagaaagacaaggaaactggcagggaaacaaagtatccctggaaggaatttcttaaagaggaagaggcagatccctacaagtttaaaatcaaagaatttgaagatgttgatcccaaagtgaaattgaaagatggacttgtgaggaaggagaaagagaagcataaagataagaagaaagatagagagaaaggcaagaaagataaagataagagagagaaagaaaaagtgaaagataaaggcagagaagataagatgaaagccccagcacccccactggtgttgcccccaaaagagttggccctgcccttgttcagccctgccacagcctccagggtcccagccatgctgccatctttgttgccagtgcttccggaaaaactgtttgaggagaaagagaaggtgaaggagaaagaaaagaaaaaggacaaaaaggagaagaagaaaaagaaggaaaaagagaaggagaagaaggagaaggaaagagagaaagagaagagagagcgagagaagagagaaaaagagaaggagaaacacaagcatgaaaaaataaaagtggaaccagtcgctctggccccgagtccagttatccccagattaactctccgagtcggtgctggccaagacaagattgtcatcagcaaggtggtccctgcccccgaggccaagccggcgccctcgcagaacaggccgaagaccccaccgccggcccccgcgcccgcccccggccccatgctcgtcagccctgcgcccgtgccgctgccgctgctcgcccaggccgccgcgggccctgccctgctgccctccccgggtcccgccgcctccggggccagtgccaaagcccccgtgcgcagcgtggtgactgagacggtcagcacctacgtgatccgagatgagtggggcaatcagatctggatctgccctgggtgtaacaagcctgacgatgggagtcccatgattgggtgtgacgactgcgatgactggtaccactggccctgtgttggaatcatgactgcacccccagaagagatgcagtggttctgccccaagtgtgcgaacaagaagaaggacaaaaagcacaagaagaggaagcatcgagcccactgacgactcccgaggggctggaccaagcggggtcagcccgggcttcttccctggcgcctctggaagggagctggtgcaagtctgccgtcacatccacccccagatgcctgtggataaagaacccaggaggactgaggctggaacacaccgcgcacctggattgttcactcccgagccgccttggcctgtggctccgtggcagtgcgacagaaggaaactcaagcagaggcgtggcctgggggctgcccctcctccacttctctaataccagtgacaagtattattaataaagagcgtacatcttcccttttgatttcctttattctctccagggccttttcattgaggtattagatgagaagataatgtacaaactgcctcaactgtaatttaaggatgatagagtctgtatacagttttcagcccctttccctctatagtaagataatcagaataacataaaagaaaactccagttggagtaccggtaaatatttttgtgataagaatatatgaagcttccctccttcccccgtttttagtactaacatgtaaaatgttcaggcttttgtgaaataccttatattttttaagaaaaaggtttctatcatgtcctgtttgcttttgtgcaaattatttttgtttaatgtattttatatcttcgttgcattctaattttgcccttctttaaactgctggagtctcttctcactgcttgtacatttcatcaacttgtataaaaactcttcagactaaaagattgcccctaatgtaaataataaatatttatgaagtagttattttttaaatttttatcgtgtttaattctggctttctctgaaatccactgtgatttcagccaggtctgtaatgacgctggacagaaacaaggctagagaaaaagccatcgttcaaagaaatttcccttgagctcagcctgcgcagtgcccggaaacatggtggggaaagggcccgagcagttggaaggaaaacaaggcaatttaaatttagagtttatgacttgaagttgttttgtttgttgtctattttgtttttgtaaatttctttgacagacttttactaaaaggacatgtagtttccatgaaagtaaaaaaaaaaaacaacaaaaaacccacatatactgtagcattttgtctttatattgttttatttctacaaatctgttcattaatattgtgctttaaggctgaaatgaagtatattatgaatttttttaagaaaactcatcaaatttcagggtatcacaaaactttattatattattatactgcccactatttattatatgttatagatgtctgagaggtaaaccaaatattttatttttaatgttaaaaaaacatcaaatttaactttattagcatattttagcaactttgggataaatacggacttttacttgattttgaaataatcccagtgtaggcccatgtgctggatctgttggatgctagaatatgggctttgaacctaatacaaatatattactagaaaatgtgatttttttaaatgccaagtaaattgatattagtgtatgaattagtcatattttaaaacattatgtggttagagaaatgcggttttctgccatgaatgttaagttgcaaatcagtggaaatggagtcgacctcttcggagcacagggtgtcattgccctcgttgttcaagaggccagaatttttctatccccgctaagaaacaaagcatctatgttgagatatgtgtttttttgtttgattaatttgagatcattctaaatactttatacaatattttcacatgcacaaaaatgcgcgttagtggtttttggagaggggtgaggggtgggggaagtgcaaaataaagattattggctattt

SEQ ID NO: 189000 - DNA, 4628 bp, Homo sapiens
  Payload ID: 17328
  Gene Symbol: TAF4
  Gene Name: TAF4 RNA polymerase II, TATA box binding protein (TBP)-associated factor, 135kDa
  Uniprot ID: O00268
  ENST ID: ENST00000252996
  CDS Start-End: 1-3258
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcggggtcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgta

SEQ ID NO: 189001 - DNA, 532 bp, Homo sapiens
  Payload ID: 17328
  Gene Symbol: TAF4
  Gene Name: TAF4 RNA polymerase II, TATA box binding protein (TBP)-associated factor, 135kDa
  ENST ID: ENST00000474089
  CDS Start-End: 1-238
gtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggcctccgtggcactcagtaagcagcgggctcagggagagcgtcctggatggtcaccatgcaggtaagatgaggaggacacttggaaccaggcattggatgcgagccccaccccatgggagggggacggggggatgctgggcaccagggggacctgtgggccagctggccctgggcttgtgcttggggagtgaatgatgggttctgacccccatgcacccctgtgggcccctggcatcactggccccatccttcacccctgccaaccacgcttgccctgtgcctctgaagctcccccactaagggggtggagtctaattccctgccccttgactgtgggttcagccatgtgacttgctttg

SEQ ID NO: 189002 - DNA, 645 bp, Homo sapiens
  Payload ID: 17328
  Gene Symbol: TAF4
  Gene Name: TAF4 RNA polymerase II, TATA box binding protein (TBP)-associated factor, 135kDa
  ENST ID: ENST00000488539
  CDS Start-End: 1-645
gtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagaga

SEQ ID NO: 189003 - DNA, 645 bp, Homo sapiens; identical to SEQ ID NO: 189002
  Payload ID: 17328
  Gene Symbol: TAF4
  Gene Name: TAF4 RNA polymerase II, TATA box binding protein (TBP)-associated factor, 135kDa
  ENST ID: ENST00000626682
  CDS Start-End: 1-645

SEQ ID NO: 189004 - DNA, 532 bp, Homo sapiens; identical to SEQ ID NO: 189001
  Payload ID: 17328
  Gene Symbol: TAF4
  Gene Name: TAF4 RNA polymerase II, TATA box binding protein (TBP)-associated factor, 135kDa
  ENST ID: ENST00000628525
  CDS Start-End: 1-238

SEQ ID NO: 189005 - DNA, 2744 bp, Homo sapiens
  Payload ID: 17328
  Gene Symbol: TAF4
  Gene Name: TAF4 RNA polymerase II, TATA box binding protein (TBP)-associated factor, 135kDa
  ENST ID: ENST00000627770
  CDS Start-End: 1-1374
gatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgta

SEQ ID NO: 189006 - DNA, 5260 bp, Homo sapiens
  Payload ID: 17329
  Gene Symbol: TAF4B
  Gene Name: TAF4b RNA polymerase II, TATA box binding protein (TBP)-associated factor, 105kDa
  Uniprot ID: Q92750
  ENST ID: ENST00000269142
  CDS Start-End: 999-3587
aagattttaggcagtttaactctaaaatatgaaaataggcacatctcacagactataaaactatacgccattttaatttttacaatgtcaattctaactgcgaattttagcaacgcttcagtgtgaagacagcagagaaaaacactgaaaatgcgtgattgaattcttattgagtcactcttctcggaaatcagtcctccccattttctccttaaaaaatagaatcctggagatagtctagtgctggcttttcgaggaacacactacaggggacacaaggagaggaacacggatgccgcagttttccaagtgcagcttgcccctcccacgtgataggtttctggcatcgcccctccttgctggcgattctggggaagattttaacgctccctggagccgtccccagtgacgtcacgggcgcggctccgctccttggccaatcacgcggccggatcccggggaaacccggggcggtggcggcggcctgggcgcgtgcgcgaggtctccgcgtggctatataaacatggctggcgtggccgcgcggcggggccgtgccaatcgcgcgtagggggctgtgggcactcggggttcgtagttttgaaatttctggcgggggagcagctgcgcagttaggctcgaggtgtgagcgacgaccttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacgcgcgtgtcctgccgtgcagcgggcgcccgtcactgacttcgctgctgcggcccccgcgcctctccccagcgatgctgtggaacccgaaccgcaccggagtcggctgccgcgcgccaagcctcccctcacctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactagtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggggaatgtgaaaatggtatcataaaacaggaaatgtgcttcatatgcccaagaggggaagaggtggaatcggaactccaaaacaactggtacatgttttgttgatgggcaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttattataagaa

SEQ ID NO: 189007 - DNA, 4753 bp, Homo sapiens
  Payload ID: 17329
  Gene Symbol: TAF4B
  Gene Name: TAF4b RNA polymerase II, TATA box binding protein (TBP)-associated factor, 105kDa
  ENST ID: ENST00000400466
  CDS Start-End: 490-3087
gtggctatataaacatggctggcgtggccgcgcggcggggccgtgccaatcgcgcgtagggggctgtgggcactcggggttcgtagttttgaaatttctggcgggggagcagctgcgcagttaggctcgaggtgtgagcgacgaccttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacgcgcgtgtcctgccgtgcagcgggcgcccgtcactgacttcgctgctgcggcccccgcgcctctccccagcgatgctgtggaacccgaaccgcaccggagtcggctgccgcgcgccaagcctcccctcacctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgttttctgctgggaccacatcaagcctgttattgggactccagttcaaatcaaacttgcccagccgggccctgtcctttcacaaccagctgggattccacaggcagttcaagtcaagcaactattctcattgtttcaggtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggggaatgtgaaaatggtatcataaaacaggaaatgtgcttcatatgcccaagaggggaagaggtggaatcggaactccaaaacaactggtacatgttttgttgatgggcaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttatt

SEQ ID NO: 189008 - DNA, 4431 bp, Homo sapiens
  Payload ID: 17329
  Gene Symbol: TAF4B
  Gene Name: TAF4b RNA polymerase II, TATA box binding protein (TBP)-associated factor, 105kDa
  Uniprot ID: Q92750
  ENST ID: ENST00000418698
  CDS Start-End: 52-1908
acctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactagtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccggtctacttttatatgcgtatattaaaatgttcaccatcggtctttttttctgtcgtgttctgtcatctcttggttggatgaagttcatctgctggtaaattcctcaggaaaggctcacagagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctatccatctcatgggactcttacagactcagattcatctttgtcttctgaaaatcagttatgaaatacactttgcacagaattaggcatctgcctatctgtgcattaaattaaagcaagttaaggccctatttgttactacctgcctcatttgccaaattgtagcaggtgaggtgtccttccctaatacagcatgcattgagatgcaggagaaaggaagaggcataagaaaatacaagaatgactatttcattctatattgaacctgtcccaaagtggtaggttttctgggctggaatcagaagttgcttagctaactatgacagtcaccctctgtacgtgacaggccactgtggtgactttggtcggctgagttccagtgttgtcaaaacaagacaaatggggatagattgtgcctggggttgctaattctctgcttcatatcaccatatgccgtttctggtaccaagtgaggggacatgcttgtcagggaaaccttaaaattgaatctactgatatatcttgttgaaaaaatggaaaaggtgcaaagtattagaaggaacgttagggcgttgctttcaaactgatgaggggaatgtgaaaatggtatcataaaacaggaaatgtgcttcatatgcccaagaggggaagaggtggaatcggaactccaaaacaactggtacatgttttgttgatgggcaaaaaaaatcacagcacaaccagaaaggagaatgtaccagatgttttcaaattagagtatttcaaaaggaaaatgttattttttgttttgtattgttttaaatcccaaggatagtttttatagttccttctgtcataatatattttagttatcctaatttttaagcatgttggcacatttaaaaaatcctaattgatgatgagaaatttttaacaataggactttatgttggattctgtacttaaaaggtactgtcaatatctcactcttggggatatgagctctaaatatgagaagcaagttatatgtgttcacctgaggaagaagctgacggacaaagcaaaccctctttaaaaaaaaaaaaaagaaaattccacgtgtgtggaatacagccggtgaaaaataatcactgtagttagaatcacatacagaaaaaaaatgattgaatcctccaagaaggtatttcaaaaatgggaaatgctatacttataagaattgaaggaaaaaaaaaaaaacacctcacgtatgttattcttcatcctgttcttcccattgggactgttatggccatattctacagtatagtaaattttaaattggccacatttttttttgtttcagcaagttatgtaaaatgctataaattatgtgtatgttaaaggagtactttaagaagagatctttatccaaagttgtttttgtatatttaaatgcttacctttattttttgtaaagtgcagcatactcatttgtgtataatcttactgatcagatgtttaaaattattccaaatacttcattaaaataattattttattataag

SEQ ID NO: 189009 - DNA, 3204 bp, Homo sapiens
  Payload ID: 17329
  Gene Symbol: TAF4B
  Gene Name: TAF4b RNA polymerase II, TATA box binding protein (TBP)-associated factor, 105kDa
  ENST ID: ENST00000578121
  CDS Start-End: 449-3052
cgtgccaatcgcgcgtagggggctgtgggcactcggggttcgtagttttgaaatttctggcgggggagcagctgcgcagttaggctcgaggtgtgagcgacgaccttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacgcgcgtgtcctgccgtgcagcgggcgcccgtcactgacttcgctgctgcggcccccgcgcctctccccagcgatgctgtggaacccgaaccgcaccggagtcggctgccgcgcgccaagcctcccctcacctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtggagagcactccggtggccctgggcgccgtgactaaggctcctgtcagcgtctgcgtggagcccacggcgtcccagcccctgcggtcccccgtggggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtccccagaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactattctcattgtttcaggtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaattttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccagatccttgctatttactgccaaagaagacacaaagcattgttgcactgtcctgaaatttcaatttctggaaaataatcaccaacatgaaagagcattgtttacagttagaaactttattaactcttacctat

SEQ ID NO: 189010 - DNA, 3268 bp, Homo sapiens
  Payload ID: 17330
  Gene Symbol: TAF5
  Gene Name: TAF5 RNA polymerase II, TATA box binding protein (TBP)-associated factor, 100kDa
  Uniprot ID: Q15542
  ENST ID: ENST00000369839
  CDS Start-End: 24-2426
gcgcgaggtggctcagccgcaagatggcggcgctggcggaggagcagacggaggtggcggtcaagctagagcctgagggaccgccaacgctgctacctccgcaggcgggggacggcgcaggcgagggtagcggcggcactaccaacaacggccccaacggcggcggcgggaacgttgcggcgtcgtcgtccactggcggggatggcgggacccccaagcccacggtggctgtctccgccgctgccccggcgggggcggccccggtgcccgccgctgctccggacgccggcgctccgcatgaccgacagactctactggccgtgctgcagttcctacggcagagcaaactccgcgaggccgaagaggcgctgcgccgtgaggccgggctgctggaggaggcagtggcgggctccggagccccgggagaggtggacagcgccggcgctgaggtgaccagcgcgcttctcagccgggtgaccgcctcggcccctggccctgcggcccccgaccctccgggcactggcgcttcgggggccacggtcgtctcaggttcagcctcaggtcctgcggctccgggtaaagttggaagtgttgctgtggaagaccagccagatgtcagtgccgtgttgtcagcctacaaccaacaaggagatcccacaatgtatgaagaatactatagtggactgaaacacttcattgaatgttccctggactgccatcgggcagagttgtcccaacttttttatcctctgtttgtgcacatgtacttggagctagtctacaatcaacatgagaatgaagcaaagtcattctttgagaagttccatggagatcaggaatgttattaccaggatgacctacgagtattatctagtcttaccaaaaaggaacacatgaaagggaatgagaccatgttggattttcgaacaagtaaatttgttctgcgtatttcccgtgactcgtaccaactcttgaagaggcatcttcaggagaaacagaacaatcagatatggaacatagttcaggagcacctctacattgacatctttgatgggatgccgcgtagtaagcaacagatagatgcgatggtgggaagtttggcaggagaggctaaacgagaggcaaacaaatcaaaggtattttttggtttattaaaagaaccagaaattgaggtacctttggatgacgaggatgaagagggagaaaatgaagaaggaaaacctaaaaagaagaagcctaaaaaagatagtattggatccaaaagcaaaaaacaagatcccaatgctccacctcagaacagaatccctcttcctgagttgaaagattcagataagttggataagataatgaatatgaaagaaaccaccaaacgagtgcgccttgggccggactgcttaccctccatttgtttctatacatttctcaatgcttaccagggtctcactgcagtggatgtcactgatgattctagtctgattgctggaggttttgcagattcaactgtcagagtgtggtcggtaacacccaaaaagcttcgtagtgtcaaacaagcatcagatcttagtcttatagacaaagaatcagatgatgtcttagaaagaatcatggatgagaaaacagcaagtgagttgaagattttgtatggtcacagtgggcctgtctacggagccagcttcagtccggataggaactatctgctttcctcttcagaggacggaactgttagattgtggagccttcaaacatttacttgtttggtgggatataaaggacacaactatccagtatgggacacacaattttctccatatggatattattttgtgtcagggggccatgaccgagtagctcggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcattttctgttcaaatgctattttaatttattacatttagaaaaaaagttgatttcaataattcatcctgcttcaagattcaaattcagaaatatactatcatcttgaattttagctgaagaatcctatgagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatacaacctagtacacttgaagtcagacagacatttcagttgcttacctccagtactgagccttgctttgggaaactaaaagatttagaccaagtcactgccagtttttgcctttgttgcattttgtacagtttttatatttttgatatcttgtaaataaagacaaccagcttttccaggttcataa

SEQ ID NO: 189011 - DNA, 3112 bp, Homo sapiens
  Payload ID: 17331
  Gene Symbol: TAF5L
  Gene Name: TAF5-like RNA polymerase II, p300/CBP-associated factor (PCAF)-associated factor, 65kDa
  Uniprot ID: O75529
  ENST ID: ENST00000258281
  CDS Start-End: 167-1936
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctggcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttc

SEQ ID NO: 189012 - DNA, 492 bp, Homo sapiens
  Payload ID: 17331
  Gene Symbol: TAF5L
  Gene Name: TAF5-like RNA polymerase II, p300/CBP-associated factor (PCAF)-associated factor, 65kDa
  ENST ID: ENST00000366674
  CDS Start-End: 167-421
gcggccgcccagagcggcggcgggggcggcggggcgcggggcgcgggggcccagctgagccggccgtcggagtgagaccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacaggtaatggtgggggctcgtctggtggggtgagcctggagcaggagaactcacgtcaatatccatgtggaattacttctcctcttctcaagacagtgccagagagagcagactgaccaaaaacctcagtgagctacgttaagtgaatgatgttggcctcagagaccctgtctgtcatttagagcgg

SEQ ID NO: 189013 - DNA, 4062 bp, Homo sapiens
  Payload ID: 17331
  Gene Symbol: TAF5L
  Gene Name: TAF5-like RNA polymerase II, p300/CBP-associated factor (PCAF)-associated factor, 65kDa
  Uniprot ID: O75529
  ENST ID: ENST00000366675
  CDS Start-End: 90-1067
ccctgcggcagagacgacggaggcggaagcaacccgatcccggaggcggcggcggcggggggagccggagccgcctgggatgttcagtcatgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggtatgaataccatttttttcttccctgcacccgccttcctaatttccttagaatgtccttaccaaacacgacatatcttagaatggacttcctagtttccctcatcatatagctaaagccagactaatgacatgttacctgtagccattgaattcctgcacatgcctaacctaagatgcaaaaacaatttttagcagcattaacttcttattaatgaatggtcagtatttatactatgtgaaatgtggatagcaacactaagcctaatgaaagacctttagctaatattgactttagctgagatttgcagtaaatatacacttatgtgtgtgcacatttgctcaggtacaaataatcggtagtaggataactgagtcgaagggcctccattgtcaactgtaatgaatattattttccccacagaaggttgtgccatttcacagtctcagcaacagtagtaagaatactggcatccctgcaccctcaccacactggatggatggtattggctttctgaggccagtgcatatcctgtggctccatgtaccccggggtgttcccagaccccacttggagaagtaacacaggaagtagagttgccagctcccctccccccgtcagtcagtgttcaatcttgtttggcttgtaaccgtttaggacagtcattgaaaagggcaggcgcagcttgggtttcaggtcaccaaaaatcactaccttagaaaaaatgtgggccaaggaagatagaaattaaacttcacagcattaacttttctttagagtggtcctgaaaaagctgtgggccaaagtatttttgtcttatcaccactgaaattcaggtagctctgcctcacattactttggatggaaaattctttacacaatgttgaataattaaggagcaaaaaaatcactctaattaaattacagttaatgataaggatgtcaagaatattgggtgccctaaattaaaccattgttttcctgttcctgttttctgagtccacttccagttaggatggcctttgaatttttgattcttgcaaccgagacagtataattgaaggatttccttgtgatgagtgaagagtctagattcccatgtagaagctttaatttctagaattttatagtactctccaaaatattttttattacatttgtatttgaattttcaaacatctcttttccttggagacagttccctttttgggagttcttctgataaaactgaggaatactgcctgcatttgctttcgattttctgtaaatacaaaaaaaaattacactgaccttattagctttgatgatacagagtttggagattattctgtgcattaaaaattaatattaaagaagatagcattatgacatctgataacagtagaccaaaataaaacattttaagactctggccactactggtaactagctctgtggcttgtcctatgtttatttccgggtatcagaagtgtatctgaagactcagaagtgaggaaccgcatgcggaattccaggaactgaaagaaattaagtatggctggagttaggagaggggccaagacaggaagtgatgtagtgacactgtcttatatgagcaattatggcggccaaactagggtagtggcagtggcaaaggagacatggatggactagagaagagctcggttattcaattactgtaggggataagggagagcaagcatcaagggtgacgtttgtgtttcaggcttaaacagttggatgtccatcaagaagaaagcaaaagacgtcattggaatggtggttttgtttaagcatttctggctttccatcatggttcatactgaaagtactgtagatgctagctaacctctgccctttttaagaataaaccttttttttaaacttaagaactaaagctgagattctcctattctgttgttgaggggcttcctgcatgcccgcccattttatcacagcaatttgagaagttttctttttggtttctgacaacaagcatttggggagaaagccaggcataaattagttacgatagttggtgtttaatgtttctccagtgaaaatttggacttttctttttcccttatagaatgcataattaaaacagactattattttgaaatgaaatattgaatattaaaaaaaataaaatagagactcttaatacaggagccacaaactcacatacctagagaaaccaaacaggtaaaagcaagtggtgaagccacatggattaatgagatgatagaaagtacaaaatcactatgtaagtcagattaaaaagccagcttgcactctctgctttcatctttttgaagcaataactattacataaatcagtgaatacagtatttctacagtatttgaaacggtgttcacacccagcaattccacttctagacatatatccaagagaatggaaaacatgtgcacacaggcacttgtacatgaatatttatggaagcattattcacaatagccaaaaagtggaaacagtccaaatggccatcaagatgaatgaataaataaaatgtagtgtgtgcatgcagtggaatattatttgcccataaaaagaaatgaagcactgatgcaggctgcaacatggatgaacttgaaagctttatgctacgtgaaagaagccagtcataaaaggtcacctactgttattcctttcataggaaatatccagataggcaagtccatagagacagagaggagaggagtggttgccaggggctgggcaaggagaatgagagtgaccgctaatgggtgtggcatttctttgtgaggtaatgaaaatgttctgtattagatagtggtgatcattgcacaactctgtgaatgtactaaaaatcattgaattgtacactttgaaagaattatatagtatgtaattatatctcagtttaaaaaaaaaaacaggataacagtaaccaaaatcttctatgtaagcttaaaattttctctgttaattatgccaaataaaactgaattcacagca

SEQ ID NO: 189014 - DNA, 2956 bp, Homo sapiens
  Payload ID: 17331
  Gene Symbol: TAF5L
  Gene Name: TAF5-like RNA polymerase II, p300/CBP-associated factor (PCAF)-associated factor, 65kDa
  Uniprot ID: O75529
  ENST ID: ENST00000366676
  CDS Start-End: 1-1770
atgaaacgagtgcgtaccgagcagattcagatggcagtgtcctgctacctcaaacgccggcagtacgtggactcagatggtcccctgaagcaaggactgcggctgtcacagactgctgaagagatggcggccaatctaacagtgcaatcagaatctggttgtgccaacatagtgtctgcagccccttgccaggcagaaccccagcaatatgaagtacagtttggacgactgcggaattttctcactgattctgattcccagcatagccacgaagtgatgcctctcctctatcctctctttgtctacctccatctcaacctggtccaaaacagtccgaagagcacagtggaaagtttttacagccgcttccatggaatgtttctgcagaatgctagccagaaggatgtcattgagcagctacagaccactcaaaccatccaggacatcctatctaacttcaagcttcgagcattcctagataacaagtacgtggtccgtctccaagaagacagctacaactaccttatccgctacctccaaagtgacaacaatactgccctgtgcaaagtcctcaccttacatattcatcttgacgtgcagcctgccaagagaacagactatcagctgtatgccagtggcagctcctcccgcagtgagaacaacggtttggagccccccgacatgcccagccctattctgcagaacgaggctgccctagaggtcttacaggagagcattaagcgagtcaaggatgggcctccctccctcactaccatctgcttctatgccttctataacacagagcagctgttgaacactgcagaaatctcccccgatagcaagctgcttgctgctgggtttgacaactcctgtataaaactttggagtttacgatccaagaagttaaaatcagagccccaccaagtagacgtgtcccgcatccatttggcttgtgatattctggaggaggaggatgatgaggatgataatgcaggcacggagatgaagatactgcggggccactgcggaccagtgtacagcacgaggttcctcgcggacagctcagggttgctctcttgttctgaagacatgtccatcagatactgggatctggggagtttcaccaacactgtgttgtaccaaggacatgcctatcctgtgtgggatctggacatcagtccatatagcctgtacttcgccagcgggtcccacgaccgcaccgccaggctgtggtcatttgatcggacgtacccgctgaggatatatgcaggacacctggcagatgtggactgtgtcaaattccaccctaattcaaactacttggccacgggctcaaccgacaagaccgtccggctgtggagcgctcagcaggggaactcggtgaggcttttcacaggccaccgtggccccgtgctttctctcgccttttctcccaacggtaagtacttggcgtctgctggcgaggaccagcggttgaagctgtgggacttggcctctgggaccctttataaagagttgagaggccacacagacaatatcaccagcctcaccttcagtccagacagcggcttgattgcctctgcctccatggacaactcggtgcgcgtctgggacatcaggaacacttactgcagtgcacctgccgacggctcctccagcgagctcgtgggcgtgtacaccgggcagatgagcaacgtcctgagcgtgcagttcatggcctgtaaccttcttctggtgactggaattacacaagaaaatcaggaacattaattttttaactttgttggaacggactggggtaacagtggaaagcctccagttgcaatccttcaatgagctgagattgaatcattgactgtgaaagagccccctcctcccctctctcctgggccctcattccgggcaggtcccccttcactcagccccccagtgtcgaaggccaaggttggggaggggaacaggagagaggcaatgatgagtgatcaagaattagagtgccctggaggtcactcacaagtcctcatggagactctgccgtgacctcgcgcatgcgagcaccttcctgtctctcattttcaccatctgactggggctaggtttggttagagggcggctgtagagcaccctcaggagaagtggcgccgcaggggtcacgcatggtccagccctcaggtgggagggaagtccttgttggcagagggatgtggggcgggaatgaggaaaggggagggcatgatcctggcaaatagtctttccttttccgtaattacagagaaccaggattttttttaattattgttattataattataattattattattattgacatgaggaaacctagcactggcagagggcaccttctctgcttttaatctttcaggtttgactcctggcactggttttgatacttggaattttgaggttcagggaattcagagaatttggtagcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaa

SEQ ID NO: 189015 - DNA, 2727 bp, Homo sapiens
  Payload ID: 17332
  Gene Symbol: TAF6
  Gene Name: TAF6 RNA polymerase II, TATA box binding protein (TBP)-associated factor, 80kDa
  Uniprot ID: P49848
  ENST ID: ENST00000344095
  CDS Start-End: 527-2560
gatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgt

SEQ ID NO: 189016 - DNA, 2464 bp, Homo sapiens
  Payload ID: 17332
  Gene Symbol: TAF6
  Gene Name: TAF6 RNA polymerase II, TATA box binding protein (TBP)-associated factor, 80kDa
  Uniprot ID: P49848
  ENST ID: ENST00000453269
  CDS Start-End: 255-2288
gacttgctcttaggctctgccaggacctgctcccacgagggggcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgtaagttctga

SEQ ID NO: 189017 - DNA, 612 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000449571
  CDS Start-End: 211-612
gttttgtggcgcctcttgaaggtcctggcagccgggtagtgaaggaataaattgcagtaattacaccaagagggagtgctccttatatatagatgtagaaacaaacttttaaaatataatttcattctgcgagcctagaggacttattctgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcat

SEQ ID NO: 189018 - DNA, 537 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000417349
  CDS Start-End: 309-537
aagatggcgccgagcgccgggtgagcagcgtctcggctgccgctagagttttcctgctccccgcgctcgggtggcgggggcgggtctgagtggtaccccggaggagaccctttgaagggtttccgtctgttacccaggctgttgtgcagtggcaccatcttggctcactgcagcctccaactcctcagttcaagcgatcctcctgcctcagcctcctaagtagctgggatgacaggttcacaccaccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagc

SEQ ID NO: 189019 - DNA, 321 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000431404
  CDS Start-End: 281-321
agagttttcctgctccccgcgctcgggtggcgggggcgggtctgagtggtaccccggaggagaccctttgaaggtcccttgtggggactggaaagaggacgaagtcttgctttgttgcccaggctggagtgcaatgacacagatctttgctcactgcaacctccgcctcccgggttcgagtgattcttctgcctcagcctcccgagtagctgtgattacagggtctccgtctctccaccgggggcttcatccttccagggaggagaagagggactccagaatggctgaggagaagaagctgaagcttagcaacactgtgct

SEQ ID NO: 189020 - DNA, 2318 bp, Homo sapiens
  Payload ID: 17332
  Gene Symbol: TAF6
  Gene Name: TAF6 RNA polymerase II, TATA box binding protein (TBP)-associated factor, 80kDa
  Uniprot ID: P49848
  ENST ID: ENST00000437822
  CDS Start-End: 96-2240
gttctgtgtcatcgtcctcctccttcaacatcccagcccaagcctcgtgcacggccaaaaaaaggaaaagcaatattcccaaccgcacaggtcccatgacaaagcgccgtctacaaacaatcaccgcttgccttcaacttcgggaagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgcta

SEQ ID NO: 189021 - DNA, 703 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000451699
  CDS Start-End: 361-703
ctgctcccacgagggggcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtttccgtctgttacccaggctgttgtgcagtggcaccatcttggctcactgcagcctccaactcctcagttcaagcgatcctcctgcctcagcctcctaagtagctgggatgacaggttcacaccaccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctga

SEQ ID NO: 189022 - DNA, 871 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000440225
  CDS Start-End: 174-871
ctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggact

SEQ ID NO: 189023 - DNA, 563 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000452438
  CDS Start-End: 96-563
acgagggggcggggccaagatggcgccgagcgccggggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcccaaagagcaacagaaggctgaagccacagaacccctgaagtcagccaagccaggccaggaggaagac

SEQ ID NO: 189024 - DNA, 2685 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000421980
  CDS Start-End: 540-884
ggggcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacggttggttgtgtgtctgtgctcgtggggaccccgtgtgtgtgcctgcattggagagatgttgcaggagatggggtgggctctctgaacctcctttcgcgctgcccggggatcttcgacctgcttctctgctgggatctcgcttaagttaacccttccctgggacgccttcctgccgcctccactgatctgaggagatcctgtgactgtagcgtgttttatgagcctttactggcagagggtaccgccgggtattgaaggattcgtaggagttcgccagggaagtgggacacgaccccctcttgtaaacccggcgccaggcacagaggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgtaagttctga

SEQ ID NO: 189025 - DNA, 2297 bp, Homo sapiens
  Payload ID: 17332
  Gene Symbol: TAF6
  Gene Name: TAF6 RNA polymerase II, TATA box binding protein (TBP)-associated factor, 80kDa
  Uniprot ID: P49848
  ENST ID: ENST00000452041
  CDS Start-End: 96-2129
acgagggggcggggccaagatggcgccgagcgccggggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgta

SEQ ID NO: 189026 - DNA, 934 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000493322
  CDS Start-End: 169-934
caagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgc

SEQ ID NO: 189027 - DNA, 2551 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000472509
  CDS Start-End: 179-2383
tagtagagatggggtttctccatgttggccaggctggtctcgaattcctgacctcaagtgatccgcccgcctcgtcctcccaaagtgctggtgggattacaggcgtgagccactgaacctggccccagcccagatttgtatctttctctgttacacctcagggctgactcacgtggggatggacataagacactcggagttcctcccctgtctccactgtcctccctttgttggccctctccctgtgtctcacgtttctttttcttctgcctgccccgttcctctgccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggtcagctaccgcatcaaagagatcgcacaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccagctcccaaagagcaacagaaggctgaagccacagaacccctgaagtcagccaagccaggccaggaggaagacggacccctgaagggcaaaggtcaaggggccaccacagccgacggcaaagggaaagagaagaaggcgccgcccttgctggagggggcccccttgcgactgaagccccggagcatccacgagttgtctgtggagcagcagctctactacaaggagatcaccgaggcctgcgtgggctcctgcgaggccaagagggcggaagccctgcaaagcattgccacggaccctggactgtatcagatgctgccacggttcagtacctttatctcggagggggtccgtgtgaacgtggttcagaacaacctggccctactcatctacctgatgcgtatggtgaaagcgctgatggacaaccccacgctctatctagaaaaatacgtccatgagctgattccagctgtgatgacctgcatcgtgagcagacagttgtgcctgcgaccagatgtggacaatcactgggcactccgagactttgctgcccgcctggtggcccagatctgcaagcattttagcacaaccactaacaacatccagtcccggatcaccaagaccttcaccaagagctgggtggacgagaagacgccctggacgactcgttatggctccatcgcaggcttggctgagctgggacacgatgttatcaagactctgattctgccccggctgcagcaggaaggggagcggatccgcagtgtgctggacggccctgtgctgagcaacattgaccggattggagcagaccatgtgcagagcctcctgctgaaacactgtgctcctgttctggcaaagctgcgcccaccgcctgacaatcaggacgcctatcgggcagaattcgggtcccttgggcccctcctctgctcccaggtggtcaaggctcgggcccaggctgctctgcaggctcagcaggtcaacaggaccactctgaccatcacgcagccccggcccacgctgaccctctcgcaggccccacagcctggccctcgcacccctggcttgctgaaggttcctggctccatcgcacttcctgtccagacactggtgtctgcacgagcggctgccccaccacagccttcccctcctccaaccaagtttattgtaatgtcatcgtcctccagcgccccatccacccagcaggtcctgtccctcagcacctcggcccccggctcaggttccaccaccacttcgcccgtcaccaccaccgtccccagcgtgcagcccatcgtcaagttggtctccaccgccaccaccgcaccccccagcactgctccctctggtcctgggagtgtccagaagtacatcgtggtctcacttcccccaacaggggagggcaaaggaggccccacctcccatccttctccagttcctcccccggcatcgtccccgtccccactcagcggcagtgccctttgtggggggaagcaggaggctggggacagtccccctccagctccagggactccaaaagccaatggctcccagcccaactccggctcccctcagcctgctccgtgatgctccacctgccagcccccggattcccacacatgcagacatgtacacacgtgcacgtacacacatgcatgctcgctaagcggaaggaagttgtagattgcttccttcatgtcactttctttttagatattgtacagccagtttctcagaataaaagtttggtttgta

SEQ ID NO: 189028 - DNA, 471 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000460673
  CDS Start-End: 444-471
gcggggccaagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtttccgtctgttacccaggctgttgtgcagtggcaccatcttggctcactgcagcctccaactcctcagttcaagcgatcctcctgcctcagcctcctaagtagctgggatgacaggttcacaccaccaggctggagtgcaatgacacagatctttgctcactgcaacctccgcctcccgggttcgagtgattcttctgcctcagcctcccgagtagctgtgattacagggtctccgtctctccaccgggggcttcatccttccagggaggagaagagggactccagaatggctgaggagaagaagctgaagctta

SEQ ID NO: 189029 - DNA, 546 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000520135
  CDS Start-End: 206-546
caagatggcgccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccg

SEQ ID NO: 189030 - DNA, 751 bp, Homo sapiens
  Payload ID: 17332
  Gene Symbol: TAF6
  Gene Name: TAF6 RNA polymerase II, TATA box binding protein (TBP)-associated factor, 80kDa
  ENST ID: ENST00000523306
  CDS Start-End: 328-751
ccgagcgccgggtgagcagcgtctcggctgccgctagagttttcctgctccccgcgctcgggtggcgggggcgggtctgagtggtaccccggaggagaccctttgaaggtcccttgtggggactggaaagaggacgggtttccgtctgttacccaggctgttgtgcagtggcaccatcttggctcactgcagcctccaactcctcagttcaagcgatcctcctgcctcagcctcctaagtagctgggatgacaggttcacaccaccagggtctccgtctctccaccgggggcttcatccttccagggaggagaagagggactccagaatggctgaggagaagaagctgaagcttagcaacactgtgctgccctcggagtccatgaaggtggtggctgaatccatgggcatcgcccagattcaggaggagacctgccagctgctaacggatgaggatgccttgaagttcatgcacatggggaagcggcagaagctcaccaccagtgacattgactacgccttgaagctaaagaatgtcgagccactctatggcttccacgcccaggagttcattcctttccgcttcgcctctggtgggggccgggagctttacttctatgaggagaaggaggttgatctgagcgacatcatcaatacccctctgccccgggtgcccctggacgtctgcctcaaagctcattggctgagcatcgagggctgccagccagctatccccgagaacccgcccccag

SEQ ID NO: 189031 - DNA, 2116 bp, Homo sapiens
  Payload ID: 17333
  Gene Symbol: TAF6L
  Gene Name: TAF6-like RNA polymerase II, p300/CBP-associated factor (PCAF)-associated factor, 65kDa
  Uniprot ID: Q9Y6J9
  ENST ID: ENST00000294168
  CDS Start-End: 202-2070
aatcaagagccaggaagcctcctggagggccggaaactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 189032 - DNA, 528 bp, Homo sapiens
  Payload ID: 17333
  Gene Symbol: TAF6L
  Gene Name: TAF6-like RNA polymerase II, p300/CBP-associated factor (PCAF)-associated factor, 65kDa
  ENST ID: ENST00000529509
  CDS Start-End: 93-528
gagtccttgctccccctccctacttactcagtgcttacttcatgatcttggagaagtcatggaacatttagcctctgagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcgg

SEQ ID NO: 189033 - DNA, 419 bp, Homo sapiens
  Payload ID: 17333
  Gene Symbol: TAF6L
  Gene Name: TAF6-like RNA polymerase II, p300/CBP-associated factor (PCAF)-associated factor, 65kDa
  ENST ID: ENST00000526261
  CDS Start-End: 269-419
gactggctgtattggggagggcggggccggggccccgggagagggaatgagtgtgagctcgtgagtgggcgccgccgccaccgcccccgccgccgtcgtctcggtagcagccttcgccacgccggggtcttcagagctccttgtttagaaactccagagcacgagcagcaaggctggtgtggagggtgttggatcacactcctgggctctccgggaggctgggcagcttttccagtcttcattctccactcccagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaata

SEQ ID NO: 189034 - DNA, 594 bp, Homo sapiens
  Payload ID: 17333
  Gene Symbol: TAF6L
  Gene Name: TAF6-like RNA polymerase II, p300/CBP-associated factor (PCAF)-associated factor, 65kDa
  ENST ID: ENST00000525405
  CDS Start-End: 138-329
attggggagggcggggccggggccccgggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgaca

SEQ ID NO: 189035 - DNA, 2334 bp, Homo sapiens
  Payload ID: 17334
  Gene Symbol: TAF7
  Gene Name: TAF7 RNA polymerase II, TATA box binding protein (TBP)-associated factor, 55kDa
  Uniprot ID: Q15545
  ENST ID: ENST00000313368
  CDS Start-End: 778-1827
actcacagccgcctcccgccccgcgtcgcgacgtagcacttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaataattgttttcccagttattcaaagcagctttctatatgtagagatgcaaattattaagttgtttccaatacaataaataaaagcatctgtttttcactttata

SEQ ID NO: 189036 - DNA, 603 bp, Homo sapiens
  Payload ID: 17334
  Gene Symbol: TAF7
  Gene Name: TAF7 RNA polymerase II, TATA box binding protein (TBP)-associated factor, 55kDa
  ENST ID: ENST00000624761
  CDS Start-End: 459-603
tccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatc

SEQ ID NO: 189037 - DNA, 2107 bp, Homo sapiens
  Payload ID: 17335
  Gene Symbol: TAF7L
  Gene Name: TAF7-like RNA polymerase II, TATA box binding protein (TBP)-associated factor, 50kDa
  Uniprot ID: Q5H9L4
  ENST ID: ENST00000324762
  CDS Start-End: 263-1171
atttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaa

SEQ ID NO: 189038 - DNA, 1579 bp, Homo sapiens
  Payload ID: 17335
  Gene Symbol: TAF7L
  Gene Name: TAF7-like RNA polymerase II, TATA box binding protein (TBP)-associated factor, 50kDa
  Uniprot ID: Q5H9L4
  ENST ID: ENST00000356784
  CDS Start-End: 116-1246
gcgttcgcctctacgttccgcgcgggagcccacgcgcggttcgtccggaacccacagaccagagacgcaggtcccagccttttcggtgtcggcgccagttcccggaggagcggacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaatagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctc

SEQ ID NO: 189039 - DNA, 2341 bp, Homo sapiens
  Payload ID: 17335
  Gene Symbol: TAF7L
  Gene Name: TAF7-like RNA polymerase II, TATA box binding protein (TBP)-associated factor, 50kDa
  Uniprot ID: Q5H9L4
  ENST ID: ENST00000372907
  CDS Start-End: 13-1401
acgaggtgggccatggagtgccccgagggacagctccccatttcttcagaaaatgattcaacaccaacagtttcaacatcggaagtaactagccaacaagaaccccaaattcttgtcgaccgtgggtctgaaaccacctatgaaagcagcgccgacattgctggcgacgaaggcacccagattcctgccgacgaggacactcaaacggatgcggacagcagcgcccaggctgctgcccaggccccagaaaacttccaggaagggaaagacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagaatatgatatgcttcgggagatgttcagtgattctagaagtaacaatgatgatgatgaggatgaggatgatgaagatgaggatgaggatgaggatgaggatgaagatgaagacaaagaagaggaggaggaagattgttctgaagagtatctggaaaggcagctgcaggccgagtttattgaatctggccagtatagggcaaatgaaggtaccagttcaatagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattctgagccttctcctcctaaccctcatcagttaaggttaggaagaacaagatgccataatgcctatgaagacttctttaacaatcttgtttgggtttttttctaggtatattattagtgttttatggtctatgttctttaagcaataaataaattgttcattttaaatgga

SEQ ID NO: 189040 - DNA, 6680 bp, Homo sapiens
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENST ID: ENST00000372977
  CDS Start-End: 19-951
acactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggccaagccgaggctgcagggtgtgatcggacatgattttcatggcaaaccgtcttattaagatgacctattttcactggatgtttgggttgaggaagatatgaacagaataatgagaatttttttttttattttgagatggagtcttactctatcacccaggctggaatgcagtggtgtgatctcagctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcaagtgatccacccgcattggcctcccaaagagttgcgattacaggtgtgagccaccacgcccagctaatttttgtatttttaatagagataaggtttcgccatgttggccaggctggtcttgaactcctgacctcaagtgataacccgcctcggcctcccaaagtgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaggaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgcccctgtgaggaatgtgtgcttgggaactgccaagtcttaccccttctggaagaagaggttttctctgacaagagcctagagcgtcggctctattatgctgggacttgacagaggagccatggggtttaaacagtaggaaagaggggctacgcgcagtggctcacgcctgtaatcccagcacttcgggaggcgaaggcaggtggatcacttgaggtcaggagttcgagaccagcctggccaacatagtgaaaccccgtctctactaaaaatacaaaaattagccgggtgtggttactcatgcctgtaatcccagctactcgggaggctgaggcaggagaatcacttgaacctgggaggcggaggttgcagtgagccgagatcgtgccactgcactccagcctgggtgacagagcgagactccatttcaaaaaaataaaaaaaggataaagtaaacaataggaaaggatttggtggggtgagggtggggtgttgagggctgggcctcatcttgtattctgaaagctgagaaacggctggtcagctggaaggctggtggatgggcaggagtgagccaagctgaggcgttctgcaagaagcaggtctgagtctgtccaaccaatttgtatcctgtggggagaacaacttcattcttaacataccctacaaaccagaaaacaagtttttaaggaagatgctgggcatgctgatagcttttctggtctcctaaggaagagtttttaaaactaaatccaaggaagaaaaatgtaacaacacgtggaagtgaacactggatgaataagcttgtttcccaaattagaatcctaacgtccatatttagcttcatgtattcccctttggcttccacagttcaactccttttattttgagacagggtctcgctgtgtcgccccagctggagtatagtggcactacctcggctcactgcaacctccactccccgggttcaagcaattctcagagtagctgggattacagatgcccgccaccacatctggctaattttttttttttttttttagtagacacgggattttgctatgttgcccaggctggtcttgaactcctggcctcaagtgatccacccgccttggccttccaaagtgttgagattacaggcgtgagccacggtgcccagcccatctcttagtcttccattcccttggtgaatttggaaacttgaaaaacttggggacttgacagcaggctccatgttcttctggcctcactgtactgtgtaaggaaagagctgcttgtcaggaacggaagaggggacgctagtaaaaaaaaaaaaattggattccccaactggactaaataggagtttttcaggtttgtagtaacgtgaaactctcctagatcgaagcagttagactggcctatgtggccttctcagggtttgtgattcagttcttagcgattcttggcctgataagtttatgaacacagccccacattcaagccgtggccaatcccagctgttctcactgctcttgggaggtgttgtcccagtcagtgtttctgcagcttccatttgttgttgttatccagtgtaagcacctgttgaatgcagatgtgctgagttagaggtgggatttggaaaagggctgctatttctgctgttgagatttcagaggctatactctttttttttcttttcttttttttttttttttgagacggcatctcactcttatcgcccaggctggagtgcaatggcgtgatctcggctcactgcaacctccacctcctgggttcaagggattctcctgcctcagcctcctgagtagctgggattacaggcacctaccacaattctcggctaattttttttgtatttttggtagagacggggtttcaccaggttggccagggtggtctcgaacacctgacctcagatgatccacccacctcggcctcccagtgtgggtgggattacaggcatgagccaccgcgcctggcctcagaggctatactcttataattttgttctgaggggagacagggaaagggttagacaacttgaaacattgaccctgtataaaaatgcaaaattctcaatgtgtatttataaatttctattttttataactttatgggacttcttagaggccaaaagtagtaaacatgcagattaaaaatgtttatgaaaatctcaataaaaattcataataaaaactttgtaaataaatagaactgtaagctttgaacttaatttgtgttcaaaagttaacagcaatgtggacaaataagtcaggcttagcccttgtgttggcctaagcacacctgggaacttagtaaaacttttattttggaaattttcaaatacaaaattagagagcaaaatatatgaacccctgtatatgcctcatcaagcttccacacttgtcagtagcttgttgattctgtttcatctgtttctcccactttttgtcctttattttctttcctcctggagtgtgtgtgtgtgtgtgtgtgcgtgtgtgtgcgtgtgagacagagtttcgcgctggagtgcaatggtgcaatcttggcccactgcaacttctgcctcccgggttcaaatgattctactgcctcagcttcctgagtagctgggattataggtatctaccaccaccaccacgcctggctaattttttcttttttttttggagacggagtctcgctctgtcgcccaggctggattgcagtggattgtcaagattgcagtggtgcaatctcagctcaccgcaagctccgccacccaggttcacgccattctcctgcctcagcctcccaagtagctgggactacaggtgcctgctaccacgcccagctaattttttgtatttttcagtagagatggagtttcactgcattagccaggatggtctcgatctcctgacctcatgatccgcccgcctcggcctcccaaagtgctgggattacaggcatgagccaccgcacctggcctaatttttttgtaggtttagtagagatggggtttcaccatgttggccagactggtctccaactcctgacctcaggtgatcacctgcctcagcctcctaaagtgctgaggttacaggcgtgagcccccgcgcctggctcttctggagtatttttaaatgcaaactccagacctgtgtcatttaatctaaatgtgtctatacgtatctctgattgatctttctttaaattttaattttggaataattatagattcacaagatgttgcaaaaaatgttgagagagatcctatgtacccatcacccactttctcccagtggtagcatcttgcataactgtggtgcaatatcaaaacccttgcattcagtttcagtgtacaatgtagatggtatattagtacaatgcatagagcttatttagttttcaccatgtgcacgtgtgtgttatgtgtgtgttgttccgtgcagtttcatcgtgtagatttgtgtaaccaccagcacacaaatggtgaagacacagaaccattgcatcagtacagttctccctcatgctgtctctttgcaatcacatccacctctctgctcttccacttctctcctggcagccactactctgttctctatctctaatgttattgaaagaatgttataaattgaatcataaagtatgtgacttttttctttttgagacagagtcttgctctatcgcctaggctggatggagtgcagtggagcgatcccagctcactgcaactcctccacctcccgggttcaagagattctcctgcctcagcctcccaagtagctgggattacaggcatgtgccaccacacccagctaacttttgtatttttagtagagatggggtttcaccatgttggccaggttggtctccaactcctgacctcaagtgatccgcccacctcagcctcccaaagtgctaggattataggtatgacccaccgcacctggccgagtatgggactttttgacgttggctttttcagttctgcataattctcttgaggtccatctaggtggttgtgtgtatcagtagttcctttctttttattgctgagtagcatggaggcaccatagtttaacacagtttctttaaccattcacgcattgagacaaaaaaagttcttaattctgcgaacatcaacttcctgtgcccaggtgcaagtgcgggggcagctggcccagggtagagctttaccatggaccctggcgctcctggaaaaaaattcaaggtatttttcctcctcttggagcgtgtggcctacctcatctccatttgattactagcttttctttttctcctttgttaaacagttatttaattttgaagagataatatatgtatacagtataaaatttaaaagacagaaaaagatataagtgataacaaaatatcttcctcctcccctgtttcccagaggctcagacctcatccctggcagctgctattatgttactgtcaatatgaccttatgtattcttccagaagtattctgtgcatcaaatgcaaatacttatattttctacttctcagtgtattttttggtgatgttccatgtcagtaataaagagcttctctgtttcgtggc

SEQ ID NO: 189041 - DNA, 794 bp, Homo sapiens
  Payload ID: 17336
  Gene Symbol: TAF8
  Gene Name: TAF8 RNA polymerase II, TATA box binding protein (TBP)-associated factor, 43kDa
  ENST ID: ENST00000372978
  CDS Start-End: 30-554
cgcgctcgcgcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccggtgagtgatgaagcactgggactgcgcgtggtgtaaagcacggagtcagttcctactgactgtcacgtggcagagtccagtccaaaagcttgttgatgaaagagtggttcaaaactcagaatgtggccgggcacattggctcacacctgtaatcccagcattttaggaggccgaggcaggaggatcacttgagcctgggagttcaagaccagcctgggcagcagagcaagaccctgtctcatttgaaaaataaataaataaagaaaaaaaaaagaa

SEQ ID NO: 189042 - DNA, 1805 bp, Homo sapiens
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENST ID: ENST00000372982
  CDS Start-End: 21-1037
gcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccggtgaagaagcccaagatccgcaggaagaagccagatacattctagagaattgtgagactttgccctaagctgccaagtgctccccaaggagatcggtcaccaggagagcagccacaaaggtcaagaaagacacacacggaagcaaacccaggctctgtgctccttccagcccttgctggtgcagatgctaccccacaagcttgtcagatcgcccaggtgacgggccaggcgcagccatcgggaaggtcattcagccaacccagaggatgtagaccctgtcctcaagaagtgcagggcgagttctgccgtgccctctgaaatactctccctcctctcagagccctccctcgagagcctgagtgcaccatgtcttgtggcctcgcctgaagccttcctctggcttcacagaatgctctggaactctggggtctggtcagggagtgtgtcctcagcttgtctggaggaggcctgcatccctcctgagctcttggaggtgcccaggaaccctgcttctcctcacagggcctggccatatagccagctccaacccaaagccctgcacagtgcctcacccactcccttctcctggtctctcctcaaaagaattttacatgattttaaaataataatagctttcatttacatagtgcttacatttatatagcacttactatgtgcgatgtactaatttaagtactttatattaactcatataataaatggacacaacacaaaactcaaaaggtacaaaagaataaaacagttaaaaact

SEQ ID NO: 189043 - DNA, 1293 bp, Homo sapiens
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENST ID: ENST00000456846
  CDS Start-End: 21-956
gcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatggaggattctggagccgagaaggagaacacctctgtcctgcagcagaacccctccttgtcgggtagccggaatggggaggagaacatcatcgataacccttatctgcggccggtgaagaagcccaagatccgcaggaagaagccagatacattctagagaattgtgagactttgccctaagctgccaagtgctccccaaggagatcggtcaccaggagagcagccacaaaggtcaagaaagacacacacggaagcaaacccaggctctgtgctccttccagcccttgctggtgcagatgctaccccacaagcttgtcagatcgcccaggtgacgggccaggcgcagccatcgggaaggtcattcagccaacccagaggatgtagaccctgtcctcaagaagtgcagggcgagttctgccgtgccctctgaaatactctccctcctctcagagccctccctcgagagcctgagtgcaccatgtcttgtggcctcg

SEQ ID NO: 189044 - DNA, 556 bp, Homo sapiens
  Payload ID: 17336
  Gene Symbol: TAF8
  Gene Name: TAF8 RNA polymerase II, TATA box binding protein (TBP)-associated factor, 43kDa
  ENST ID: ENST00000482432
  CDS Start-End: 373-555
ttttatcttttgccctcctctcctcgcggtcacctcttgttactgttttcattttccctttcaatgaaatggtgtgaagatgggaggcacaagagagggatcctgttttttctgcgggacacgtcttaatcccatcatgcgtgtttcttcagctatgtattctaataatctgctaaagtagaaagtaaaagacctgctattttatctcattgggactgtacgttttagagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcgtaagtgac

SEQ ID NO: 189045 - DNA, 719 bp, Homo sapiens
  Payload ID: 17336
  Gene Symbol: TAF8
  Gene Name: TAF8 RNA polymerase II, TATA box binding protein (TBP)-associated factor, 43kDa
  ENST ID: ENST00000472818
  CDS Start-End: 19-390
acactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcgtaagtgactttgaactgaggtacttagcaatttttcaattaatgcttgtggaatgaagtaattgaatatggtagggattggattagtagctacttccttgttgtgggctctcttccaatgtttggggctacctacaatataatctttatttgggctagtctgattagcatgtgaaattcagtcaccaaaaggtaaaccatctttgagatattgctgtgtttcttgtgttctagccccagaagggcaaatgatgctgcttggaaaaatgaaagtttttgttcttcttagattaagggttggtaaattgtggcctatgggccaaatgcagcctgcctc

SEQ ID NO: 189046 - DNA, 2402 bp, Homo sapiens
  Payload ID: 17336
  Gene Symbol: TAF8
  Gene Name: TAF8 RNA polymerase II, TATA box binding protein (TBP)-associated factor, 43kDa
  Uniprot ID: Q7Z7C8
  ENST ID: ENST00000494547
  CDS Start-End: 21-1037
gcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggccaagccgaggctgcagggtgtgatcggacatgattttcatggcaaaccgtcttattaagatgacctattttcactggatgtttgggttgaggaagatatgaacagaataatgagaatttttttttttattttgagatggagtcttactctatcacccaggctggaatgcagtggtgtgatctcagctcactgcagtctcagcaaccctgggtccaagtgattctcctgccttggcctcccgagtagctgggactagaggcaagcgccaccatgctggctaatttttgtattttgagtagagatagggtttcgccatgttggccaggctggtcttgaactcctgacctcaagtgatccacccgcattggcctcccaaagagttgcgattacaggtgtgagccaccacgcccagctaatttttgtatttttaatagagataaggtttcgccatgttggccaggctggtcttgaactcctgacctcaagtgataacccgcctcggcctcccaaagtgctgagattacaggcgtgagccaccgcaccccaccagagactttcttaatcaatcaggctatgtggtggggcatagcagcagccagtgacttcgttcattatcacaggatttgattcctttgaaactcaagagaccagggaaagtgacaggaaggaaagggctctttgctgctgtgcttattacaaggaagactgtttgtccagcgtgtatttcaggatatctggatcccttttattgactcacaatttgtggcaccactttctcatcccagaacttcattcttatttctctcctcatctggcctcccaagtgctccgttgagctgatgaaaagttctttgtactccctcaacgtgtcggaaacaggaggccacacagcacagctttgtttggggtgggcaggagtcaggagtcttgagcagatgcatcactgtgaagaagaacgacatgtcggggctgcacctgtcctcccgtcggcatttgacgaaagctccctgaagcggggcagcactctcctcctgagagatttaccatttattgcccctgtgaggaatgtgtgcttgggaactgccaagtcttaccccttctggaagaagaggttttctctgacaagagcctagagcgtcggctctattatgctgggacttgacagaggagccatggggtttaaacagtaggaaagaggggctacgcgcagtggctcacgcctgtaatccca

SEQ ID NO: 189047 - DNA, 1222 bp, Homo sapiens
  Payload ID: 17336
  Gene Symbol: TAF8
  Gene Name: TAF8 RNA polymerase II, TATA box binding protein (TBP)-associated factor, 43kDa
  ENST ID: ENST00000465926
  CDS Start-End: 421-1125
gaaaggcattcccgtttcaaaatatttagctttcttacttttttgtgcttttatcttttgccctcctctcctcgcggtcacctcttgttactgttttcattttccctttcaatgaaatggtgtgaagatgggaggcacaagagagggatcctgttttttctgcgggacacgtcttaatcccatcatgcgtgtttcttcagctatgtattctaataatctgctaaagtagaaagtaaaagacctgctattttatctcattgggactgtacgttttagagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccatctcttcttccgtctgaactggagatgcaacaaatggaagagacagattcctcggagcaggatgaacagacagacacagagaaccttgctcttcatatcagcatggaggattctggagccgagaaggagaacacctctgtcctgcagcagaacccctccttgtcgggtagccggaatggggaggagaacatcatcgataacccttatctgcggccggtgaagaagcccaagatccgcaggaagaagtccctctcctgagctgagaaggaaacctggcttgtacaggggcgcagattccaccctcccggggagttaaagccactcaagggaagaagagggtgacctcctcatggcc

SEQ ID NO: 189048 - DNA, 1283 bp, Homo sapiens; identical to SEQ ID NO: 105326
  Payload ID: 17337
  Gene Symbol: TAF9
  Gene Name: TAF9 RNA polymerase II, TATA box binding protein (TBP)-associated factor, 32kDa
  Uniprot ID: Q16594
  ENST ID: ENST00000217893
  CDS Start-End: 291-1085

SEQ ID NO: 189049 - DNA, 1461 bp, Homo sapiens
  Payload ID: 17337
  Gene Symbol: TAF9
  Gene Name: TAF9 RNA polymerase II, TATA box binding protein (TBP)-associated factor, 32kDa
  Uniprot ID: Q16594
  ENST ID: ENST00000328663
  CDS Start-End: 468-1262
cccaggaaagcttgaaggcagagatagactcacgtctctaagacatatacataatatagccgcaaccgcggcggccttactttcccggagctgcatccccttttaggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcg

SEQ ID NO: 189050 - DNA, 1331 bp, Homo sapiens; identical to SEQ ID NO: 105327
  Payload ID: 17337
  Gene Symbol: TAF9
  Gene Name: TAF9 RNA polymerase II, TATA box binding protein (TBP)-associated factor, 32kDa
  Uniprot ID: Q16594
  ENST ID: ENST00000506736
  CDS Start-End: 337-1131

SEQ ID NO: 189051 - DNA, 582 bp, Homo sapiens; identical to SEQ ID NO: 105331
  Payload ID: 17337
  Gene Symbol: TAF9
  Gene Name: TAF9 RNA polymerase II, TATA box binding protein (TBP)-associated factor, 32kDa
  ENST ID: ENST00000512152
  CDS Start-End: 202-582

SEQ ID NO: 189052 - DNA, 966 bp, Homo sapiens; identical to SEQ ID NO: 105332
  Payload ID: 17337
  Gene Symbol: TAF9
  Gene Name: TAF9 RNA polymerase II, TATA box binding protein (TBP)-associated factor, 32kDa
  ENST ID: ENST00000503245
  CDS Start-End: 374-966

SEQ ID NO: 189053 - DNA, 588 bp, Homo sapiens; identical to SEQ ID NO: 105334
  Payload ID: 17337
  Gene Symbol: TAF9
  Gene Name: TAF9 RNA polymerase II, TATA box binding protein (TBP)-associated factor, 32kDa
  ENST ID: ENST00000504109
  CDS Start-End: 182-588

SEQ ID NO: 189054 - DNA, 761 bp, Homo sapiens; identical to SEQ ID NO: 105335
  Payload ID: 17337
  Gene Symbol: TAF9
  Gene Name: TAF9 RNA polymerase II, TATA box binding protein (TBP)-associated factor, 32kDa
  ENST ID: ENST00000509462
  CDS Start-End: 263-761

SEQ ID NO: 189055 - DNA, 1057 bp, Homo sapiens
  Payload ID: 17337
  Gene Symbol: TAF9
  Gene Name: TAF9 RNA polymerase II, TATA box binding protein (TBP)-associated factor, 32kDa
  ENST ID: ENST00000508954
  CDS Start-End: 752-1057
ccggtcagggcgcgcggccgggagggactgggctggggcaggctgggggcgcagagtgctctgggcatcgggcgcccaggtgggggcccctcactgccctcttcagaggccggccgagggccacgaggcggttgtcagcgccccgggagccgaccctcgcgggcgttgcgggaggcgagggaggggacgcggaacgttaattccgttggcctgaggctccgggggggggcgggggggggtggagagaggtcggcagatccagctctccagcttggcaacctgcttagtctttctgaatctggtatttcgtttgtaaaatgggttgttgattctttggcagggttggccttgggatttttagcgaaataacgtaaggccatatctgcttcccggtagagtcattaatggtggatgcctcactccttaggcctccgtgggccgtattttattttttctttgcttctgataaacgcctcagattagatttcggtaaacgagttcagatgtttgtgacgtgacgaaattgctgtatgcttttgttgagttacatcaaaggatccccccgccccttaaaaggaaggcatatagagcatttcgggtcgtttctcgcgtaggagtgggtctttgaagccatactcagggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacc

SEQ ID NO: 189056 - DNA, 1183 bp, Homo sapiens
  Payload ID: 17337
  Gene Symbol: TAF9
  Gene Name: TAF9 RNA polymerase II, TATA box binding protein (TBP)-associated factor, 32kDa
  ENST ID: ENST00000620269
  CDS Start-End: 339-848
cccaggaaagcttgaaggcagagatagactcgcgtctctaagacatatacataatatagccgcaaccgcggcggccttactttcccggagctgcatccccttttgggcgaagagcggaggcgaccagggactaccctaggtgaaagggcagccacctggccctacccgggctcaacgccgagcctctcggaggtacggcctcccggggaccttccagactggtcggcgcaagcgaagggcggggaccaccgaaggagtgtgtgacttaggcatccagcgcactgcctgacccgaagtaccgacccgagttatgcccaccctccaactttgcgacggaaatgtgtcatcgaaagccaggtacaccaggggttggaaaaaccacactaggcaaagaacttgcgtcaaaatcaggactgaaatacattaatgtgggtgatttagctcgagaagagcaattgtatgatggctatgatgaagagtatgactgtcccattttagatgaagacagagtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaa

SEQ ID NO: 189057 - DNA, 587 bp, Homo sapiens; identical to SEQ ID NO: 105325
  Payload ID: 17337
  Gene Symbol: TAF9
  Gene Name: TAF9 RNA polymerase II, TATA box binding protein (TBP)-associated factor, 32kDa
  ENST ID: ENST00000617079
  CDS Start-End: 31-456

SEQ ID NO: 189058 - DNA, 1648 bp, Homo sapiens; identical to SEQ ID NO: 105324
  Payload ID: 17337
  Gene Symbol: TAF9
  Gene Name: TAF9 RNA polymerase II, TATA box binding protein (TBP)-associated factor, 32kDa
  ENST ID: ENST00000612207
  CDS Start-End: 53-571

SEQ ID NO: 189059 - DNA, 743 bp, Homo sapiens; identical to SEQ ID NO: 105333
  Payload ID: 17337
  Gene Symbol: TAF9
  Gene Name: TAF9 RNA polymerase II, TATA box binding protein (TBP)-associated factor, 32kDa
  ENST ID: ENST00000618233
  CDS Start-End: 14-157

SEQ ID NO: 189060 - DNA, 483 bp, Homo sapiens; identical to SEQ ID NO: 105330
  Payload ID: 17337
  Gene Symbol: TAF9
  Gene Name: TAF9 RNA polymerase II, TATA box binding protein (TBP)-associated factor, 32kDa
  ENST ID: ENST00000625009
  CDS Start-End: 1-330

SEQ ID NO: 189061 - DNA, 2713 bp, Homo sapiens
  Payload ID: 17338
  Gene Symbol: TAF9B
  Gene Name: TAF9B RNA polymerase II, TATA box binding protein (TBP)-associated factor, 31kDa
  Uniprot ID: Q9HBM6
  ENST ID: ENST00000341864
  CDS Start-End: 96-851
cctcctcccgctccccgcaggggtggagcctgagcgaggagcccgcgagctctcctctctcctctgtctccgcggatgacgagtggctggataacatggagtcgggcaagatggcgcctcccaagaacgctccgagagatgccttggtgatggcacagatcctgaaggatatgggaatcacagagtatgaaccaagggttataaatcaaatgttggaatttgctttccgttatgtgactacaattctggatgatgcaaaaatttattcgagccatgctaagaaacctaatgttgatgcagatgatgtgagactggcaatccagtgtcgtgctgaccaatcttttacctctcctcccccaagagattttttactggatatcgcaaggcagaaaaatcaaacccctttgccactgattaagccatatgcaggacctagactgccacctgatagatactgcttaacagctccaaactataggctgaagtccttaattaaaaagggacctaaccaagggagactagttccacgattaagtgttggtgctgttagtagcaaacctactactcctactatagcaaccccacaaacggtgtctgtcccaaataaagttgcaactccaatgtcagtgacaagccaaagatttacggtgcagattccaccttctcagtccacacctgtcaaaccagttcctgcaacaactgcagttcaaaatgttctgattaatccttcaatgattgggcccaaaaatattcttattaccaccaacatggtttcgtcacagaacacagccaatgaagcaaacccactgaagagaaaacatgaagatgatgatgacaatgatattatgtaaggaatatagtctagtctagatgcatttcaaaaggaaagttggttttgagcccagtatactgaactagaatattctagatcttgttttaccttaaaagactgaaatgtagctgcagtatttttcgtcagttaaaactgttagatctctttagtaaacatacaaatgtgtttttcagtaggcttcaattacaaacagttaagtacttgtttcttaatagtttcattaatgttgagtcctaatatggcaattctgtttttgagacacttttctgccttctatcactgatagtagcatttaagtttcagattctacagcctagtcagcagatttatctttgacagcataatttctgatctacatttaaatactactttattttataaggtaatatagttacttactgtcactagctaatttttttttttttaccaaatctctcaatataggaaacattttttggaaaggatggatttagaggagagattctaaatccattttggatgtatttgtttctttgacttccttaacttccaaactcaactccctttctagatcccattcattttctgcacctcccccataggcttgtttctctccattgctattaaatgtagaaggccatacctggaattttaaaaatattattcctggtaatacagctcagtgtcattttcctatttttaaaacatgctctacatgcctaatgttttgtgattcactttaacctgatggtttgcatttgctgtttttcactcttatgtcagagcagttgggttttaccccttagtttttatgcctgttaagctttactgtgcttttgacaggtagttttgggtcagttatattcagttttagtattgtattccaagttgataactcttccatgtttcacatttctaaatttaacagagatgctgtagcttaaaacatgttttgataagtaattacactggacctaggcaaaaccactgaagaacaagtgttcctttttaccacatacatattatgttttgatcactgctgcttgagccccgctattggtataattcagatcattttagcttgttgctgaggatgtcacatataagacaggatcaaacctgaaagacactaatggttcatcctctataaggccaacaaagaaaacaaattaatgtgatgtaacttgcatttatgtgcactctgcataggtttcccaataatactgtaatgttgctgaacacctttccctgttttccatttatacacatattaaagtcatattgggaaagatggcaaagcttttgagaatataaacacacctgttttgtttttcttaagttcaacatacttttgtagaatttgtaaaataaatgttcgtatcataattgagaatttatagccaaggatcctcaaaacagaagtttcatcttaggatagtgtttgatatatctaagaaagtccagtaacagagaagaaatgtctcaaatgtctcgtatcagttttagtgtttttcagtattagggaaaggtaatataaaaacaggtaaaatgtataaaaatagacctgatcaacatcataggagataaatattcattatatagcataggatattattacttgaatgttctcagggaggcagcaagtcagaaggcctaggttctagtcctagctccatcatttaccaactgtgtgaccttacttcacctcttagccttgttctcctcactagcagtaggaaagtaacacctaccctgcctacctcacagggctgttgtgagggttcaattggtatatgtgaaaattctttcagaattgtaaaatgctatatgactgtaaggaattattgcatttgttccaaggttaataaaaatttgagctta

SEQ ID NO: 189062 - DNA, 1596 bp, Homo sapiens
  Payload ID: 17339
  Gene Symbol: TAZ
  Gene Name: tafazzin
  ENST ID: ENST00000369776
  CDS Start-End: 86-874
tctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggagggatcctgaaactccgccacatctggaacctgaagttgatgcgttggacccctgcagctgcagacatctgcttcaccaaggagctacactcccacttcttcagcttgggcaagtgtgtgcctgtgtgccgaggagatggcgtctaccagaaggggatggacttcattttggagaagctcaaccatggggactgggtgcatatcttcccagaaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttcccccccaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaa

SEQ ID NO: 189063 - DNA, 567 bp, Homo sapiens
  Payload ID: 17339
  Gene Symbol: TAZ
  Gene Name: tafazzin
  ENST ID: ENST00000439735
  CDS Start-End: 15-567
cgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcg

SEQ ID NO: 189064 - DNA, 864 bp, Homo sapiens
  Payload ID: 17339
  Gene Symbol: TAZ
  Gene Name: tafazzin
  ENST ID: ENST00000426231
  CDS Start-End: 1-104
ccctcatcaccgtgtccaatcaccagtcctgcatggacgaccctcatctctgggggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccag

SEQ ID NO: 189065 - DNA, 1862 bp, Homo sapiens
  Payload ID: 17339
  Gene Symbol: TAZ
  Gene Name: tafazzin
  Uniprot ID: Q16635
  ENST ID: ENST00000475699
  CDS Start-End: 304-1140
tttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaaggagatggcgtctaccagaaggggatggacttcattttggagaagctcaaccatggggactgggtgcatatcttcccagaaggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttcccccccaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaa

SEQ ID NO: 189066 - DNA, 1889 bp, Homo sapiens
  Payload ID: 17339
  Gene Symbol: TAZ
  Gene Name: tafazzin
  Uniprot ID: Q16635
  ENST ID: ENST00000601016
  CDS Start-End: 289-1167
ccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaaaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttcccccccaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaa

SEQ ID NO: 189067 - DNA, 1485 bp, Homo sapiens
  Payload ID: 17339
  Gene Symbol: TAZ
  Gene Name: tafazzin
  Uniprot ID: Q16635
  ENST ID: ENST00000613002
  CDS Start-End: 304-1050
tttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagatggcgtctaccagaaggggatggacttcattttggagaagctcaaccatggggactgggtgcatatcttcccagaaggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgt

SEQ ID NO: 189068 - DNA, 773 bp, Homo sapiens
  Payload ID: 17339
  Gene Symbol: TAZ
  Gene Name: tafazzin
  ENST ID: ENST00000620808
  CDS Start-End: 271-558
gcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggtgaggaggaatgggcccctcgaagtgggccgggccggccccacctgcctctgcccagatttgccctcctcctgctctgcccaggaggacccctgcagctgcagacatctgcttcaccaaggagctacactcccacttcttcagcttgggcaagtgtgtgcctgtgtgccgaggaatcgggcgcctgattgctgagtgtcatctcaaccccatcatcct

SEQ ID NO: 189069 - DNA, 1900 bp, Homo sapiens
  Payload ID: 17339
  Gene Symbol: TAZ
  Gene Name: tafazzin
  ENST ID: ENST00000615986
  CDS Start-End: 284-571
ccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggacccctgcagctgcagacatctgcttcaccaaggagctacactcccacttcttcagcttgggcaagtgtgtgcctgtgtgccgaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttcccccccaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgttgtaaaa

SEQ ID NO: 189070 - DNA, 1793 bp, Homo sapiens
  Payload ID: 17339
  Gene Symbol: TAZ
  Gene Name: tafazzin
  Uniprot ID: Q16635
  ENST ID: ENST00000612460
  CDS Start-End: 289-1077
ccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatcatcctgcccctgtggcatgtcggaatgaatgacgtccttcctaacagtccgccctacttcccccgctttggacagaaaatcactgtgctgatcgggaagcccttcagtgccctgcctgtactcgagcggctccgggcggagaacaagtcggctgtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggctctctttccttcttgccttcagatgttctctcccaggggctggcttcaggagggagcatagaaggcaggtgagcaaccagttggctaggggagcagggggcccaccagagctgtggagaggggaccctaagactcctcggcctggctcctacccaccgcccttgccgaaccaggagctgctcactacctcctcagggatggccgttggccacgtcttccttctgcctgagcttcccccccaccacaggccctttcctcaggcaaggtctggcctcaggtgggccgcaggcgggaaaagcagcccttggccagaagtcaagcccagccacgtggagcctagagtgagggcctgaggtctggctgcttgcccccatgctggcgccaacaacttctccatcctttctgcctctcaacatcacttgaatcctagggcctgggttttcatgtttttgaaacagaaccataaagcatatgtgttggcttgtt

SEQ ID NO: 189071 - DNA, 770 bp, Homo sapiens
  Payload ID: 17339
  Gene Symbol: TAZ
  Gene Name: tafazzin
  ENST ID: ENST00000617701
  CDS Start-End: 283-570
cggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccaagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggacccctgcagctgcagacatctgcttcaccaaggagctacactcccacttcttcagcttgggcaagtgtgtgcctgtgtgccgag

SEQ ID NO: 189072 - DNA, 877 bp, Homo sapiens
  Payload ID: 17339
  Gene Symbol: TAZ
  Gene Name: tafazzin
  ENST ID: ENST00000612012
  CDS Start-End: 289-877
ccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggagagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagatggcgtctaccagaaggggatggacttcattttggagaagctcaaccatggggactgggtgcatatcttcccagaagggaaagtgaacatgagttccgaattcctgcgtttcaagtggggaatcgggcgcctgattgctgagtgtcatctcaaccccatca

SEQ ID NO: 189073 - DNA, 815 bp, Homo sapiens
  Payload ID: 17339
  Gene Symbol: TAZ
  Gene Name: tafazzin
  ENST ID: ENST00000616020
  CDS Start-End: 304-815
tttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggagagtacatgaaccacctgaccgtgcacaacagggaggtgctgtacgagctcatcgagaagcgaggcccggccacgcccctcatcaccgtgtccaatcaccagtcctgcatggacgaccctcatctctgggggatcctgaaactccgccacatctggaacctgaagttgatgcgttggacccctgcagctgcagacatctgcttcaccaaggagctacactcccacttcttcagcttgggcaagtgtgtgcctgtgtgccgaggagcagaatttttccaagcagagaatgaggggaaaggtgttctagacacaggcaggcacatgccaggtgctggaaaaagaagagagaa

SEQ ID NO: 189074 - DNA, 8823 bp, Homo sapiens
  Payload ID: 17340
  Gene Symbol: TLN1
  Gene Name: talin 1
  Uniprot ID: Q9Y490
  ENST ID: ENST00000314888
  CDS Start-End: 355-7980
ggaagagttctagcctgaaagggaactcgggcgtcgtcctggcgtcctctccggattgcgccgcaccctcgcttcctgccagggaggggctgccgggctttggcggctcccgagcatcgagaacggggccagagcagcttcctgcctgccccccgcgaccatagagcgcgggcccagggcgccgcccgcgggtgggggacgttcccaggacggaagtggccgagagagtgtcgaagggagggcgaggccggagcccgagggcgacccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgcgacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaggcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccggccagtccccacagcctcatcagctctcttcaccgttttttgatactatcttcccccacccccagctacccataggggctgcagagttataagccccaaacaggtcatgctccaataaaaatgattctacctacaacctctgcctggcttcaagggagatacaagttttctcccagggcagtaggagagacagtggggttgaattctgtcacccagcttgatccagcttgaaatgggagaggggaagactggcagtctgcacctgaggtcccttcctccttgcacccggaccctaaagttatccaatggggaagttgtgcctgagaagtcatactcctgttatcctcacctccctggccagcacctaagcctcacaaagtgtcgttctgctgctgctgggacagcagctaccacagttccttgtggctaccaggacattctgttcttcatagctactcagggtatgtcaacaaatccagtccttgaccaaattcaaattttcaaaagaagctttgctaaaaataa

SEQ ID NO: 189075 - DNA, 11650 bp, Homo sapiens
  Payload ID: 17341
  Gene Symbol: TLN2
  Gene Name: talin 2
  Uniprot ID: Q9Y4G6
  ENST ID: ENST00000306829
  CDS Start-End: 1-7629
atggtggccctgtccttaaagatttgtgtgcgccactgcaacgtggtgaagaccatgcagtttgaaccatctacagctgtgtacgatgcgtgtcgagtcattcgggaacgggtgcctgaggcacaaactgggcaagcttctgactatggactctttctttcggatgaagacccgaggaaagggatttggctggaagcgggcagaacactggattactacatgttgcggaatggggatattttggaatataaaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgacctaaattggctggatcacagccgaacattcagagaacaaggagtagatgaaaacgaaacgttgctgcttagacggaagttcttttactctgatcagaatgtagattcgagagaccccgtgcagctgaacttgctttatgttcaggcacgggatgacatcctgaatggctctcaccctgtctccttcgagaaagcttgtgagtttggtggatttcaagcccagatacaatttggacctcatgtggaacataaacacaaacctggatttttagatctgaaggaattcctgcccaaagaatatatcaagcagagaggagctgaaaagaggatctttcaggagcataagaactgcggagagatgagtgagatagaagccaaggtcaagtacgtcaaactcgcacggtccctccgcacatatggcgtgtccttcttcctggtgaaggagaagatgaaaggcaagaacaagctggtgcctcgcctgctggggatcaccaaagactcggtgatgcgcgtggatgagaagaccaaggaagtgctgcaggagtggcccctcaccaccgtcaagcgctgggcagcctcacccaagagcttcacactggattttggggagtatcaggaaagctactattcagtacaaaccaccgagggagagcagatatcccagctgattgcaggctacattgacatcatcctgaaaaagaaacaaagtaaagatcgatttggactagaaggtgatgaggagtcaaccatgttagaagagtccgtttccccaaaaaagtccaccatcttgcagcagcagttcaaccggaccgggaaggcagagcacggctcagtggcgctgccggccgtgatgcgctcgggctccagcgggcctgagaccttcaacgttggcagcatgccctcgccacagcagcaggtcatggttgggcagatgcaccgaggccacatgccgccactgacctcagcccagcaggccctgatggggaccatcaacacaagcatgcacgccgtccagcaggcccaggatgatctcagtgagctcgactcgctgccacctctcggccaggatatggcatctagggtatgggttcagaacaaagtcgacgaatccaaacacgaaatccattctcaagttgatgctatcacggccggaacggcttcagttgttaacctcacagctggtgaccctgcagacactgactacacagctgtgggatgtgcgatcaccactatttcttccaacctgacggagatgtccaagggtgtgaagctattggccgccctcatggatgatgaggtgggcagcggggaggacttgctcagagctgccaggaccctcgctggggcggtgtcagacttgctgaaagctgtgcagcctacttctggagagcctcgacagacagttttgactgctgctggcagcatcggacaagccagtggggatcttctgagacagattggagagaatgagactgatgagcgattccaggatgttttaatgagtttggccaaagctgttgccaatgcagctgccatgttggtactaaaggcaaagaatgttgcccaagtggccgaagacactgtcctacagaacagggtaattgctgctgccacccagtgtgccctctccacctcccagcttgtggcatgtgccaaggttgtgagccccactattagctcccctgtgtgccaggagcagctgattgaagcagggaagctggtggaccgctcggtggagaactgtgtccgtgcctgccaggcggccactaccgatagtgagctcctgaagcaggtcagcgcagcggccagcgtggtcagccaggccctccatgatctcctgcagcatgtgcggcagtttgccagccgaggcgagcccatcggccgctacgaccaggctactgacaccatcatgtgtgtcaccgagagcatcttcagctccatgggtgacgctggtgaaatggtgcgccaggcgcgggttctggcccaagccacatcagacctcgtcaatgccatgaggtcagatgcagaagccgaaatcgacatggagaattcaaagaagctcctggcagcagcaaaactcttagctgactccactgctcgcatggtggaagctgcaaagggggctgcagccaacccagagaatgaggaccagcagcaaaggctgagagaagctgcagaaggcctccgggtagcaaccaacgcagctgcccagaatgctattaagaaaaaaattgtcaaccgactggaggttgcagccaagcaggccgcagcggcagccacacagaccatcgccgcctcccagaatgcagctgtttccaacaagaaccctgcggcccagcagcagctggtccagagttgcaaggcagtggctgatcacatccctcagctggtccagggagtgagggggagccaagctcaagctgaagacctgagtgcccagctggctctcatcatctccagccagaacttcctccagcctggaagcaagatggtgtcctctgccaaagccgcagtgcccaccgtgagtgaccaggccgcagccatgcagctgagccagtgtgccaagaacctggccaccagcttggcggagctgcgtaccgcctcgcagaaggcccatgaagcttgtggtccgatggaaatcgattcagctctgaatacggtgcagacgcttaagaatgaactgcaggatgccaagatggcagccgtggagagccagctgaagccacttccaggggaaacgctggaaaaatgtgctcaggacctgggaagcacatccaaggcggtgggctcctccatggcacagctgctgacctgtgctgctcaaggcaacgaacactacacaggggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcagacaaaagaagaccagatccaagtgatagggaacctcaagaatatctcgatggcatccagcaagctgctgttagctgccaagtctctctctgtagatccaggagctcccaatgcgaaaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctctgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgcaatgcctgccgcatcgcctcatccaagacggccaacccagtagccaagaggcacttcgtccagtcagccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaggaacaaa

SEQ ID NO: 189076 - DNA, 11880 bp, Homo sapiens
  Payload ID: 17341
  Gene Symbol: TLN2
  Gene Name: talin 2
  Uniprot ID: Q9Y4G6
  ENST ID: ENST00000561311
  CDS Start-End: 231-7859
cttcatttcctcaagctccctccttaacagctaacgccttcgcgagaggagctgagggccctatgcggaataattaagatgccttctttagggtctctgccttggggccattttacaggtgctgcaggaggcttctcacatgctttgggatatcttcagggaaatacgctcttaatagaaactgagaatttaagacattctaagtgagactgtccacatcatctaggaaaatggtggccctgtccttaaagatttgtgtgcgccactgcaacgtggtgaagaccatgcagtttgaaccatctacagctgtgtacgatgcgtgtcgagtcattcgggaacgggtgcctgaggcacaaactgggcaagcttctgactatggactctttctttcggatgaagacccgaggaaagggatttggctggaagcgggcagaacactggattactacatgttgcggaatggggatattttggaatataaaaagaaacagagacctcagaaaatccggatgctggatggatctgtgaagacagtgatggtggatgattccaagactgtgggggagctcctggtcactatttgtagcagaataggaataacaaattatgaagaatactccttaatccaagaaactattgaagaaaagaaagaggaaggaacgggcacactcaaaaaagacaggacactgttacgagatgagaggaaaatggagaagttgaaggccaagctgcacacagatgatgacctaaattggctggatcacagccgaacattcagagaacaaggagtagatgaaaacgaaacgttgctgcttagacggaagttcttttactctgatcagaatgtagattcgagagaccccgtgcagctgaacttgctttatgttcaggcacgggatgacatcctgaatggctctcaccctgtctccttcgagaaagcttgtgagtttggtggatttcaagcccagatacaatttggacctcatgtggaacataaacacaaacctggatttttagatctgaaggaattcctgcccaaagaatatatcaagcagagaggagctgaaaagaggatctttcaggagcataagaactgcggagagatgagtgagatagaagccaaggtcaagtacgtcaaactcgcacggtccctccgcacatatggcgtgtccttcttcctggtgaaggagaagatgaaaggcaagaacaagctggtgcctcgcctgctggggatcaccaaagactcggtgatgcgcgtggatgagaagaccaaggaagtgctgcaggagtggcccctcaccaccgtcaagcgctgggcagcctcacccaagagcttcacactggattttggggagtatcaggaaagctactattcagtacaaaccaccgagggagagcagatatcccagctgattgcaggctacattgacatcatcctgaaaaagaaacaaagtaaagatcgatttggactagaaggtgatgaggagtcaaccatgttagaagagtccgtttccccaaaaaagtccaccatcttgcagcagcagttcaaccggaccgggaaggcagagcacggctcagtggcgctgccggccgtgatgcgctcgggctccagcgggcctgagaccttcaacgttggcagcatgccctcgccacagcagcaggtcatggttgggcagatgcaccgaggccacatgccgccactgacctcagcccagcaggccctgatggggaccatcaacacaagcatgcacgccgtccagcaggcccaggatgatctcagtgagctcgactcgctgccacctctcggccaggatatggcatctagggtatgggttcagaacaaagtcgacgaatccaaacacgaaatccattctcaagttgatgctatcacggccggaacggcttcagttgttaacctcacagctggtgaccctgcagacactgactacacagctgtgggatgtgcgatcaccactatttcttccaacctgacggagatgtccaagggtgtgaagctattggccgccctcatggatgatgaggtgggcagcggggaggacttgctcagagctgccaggaccctcgctggggcggtgtcagacttgctgaaagctgtgcagcctacttctggagagcctcgacagacagttttgactgctgctggcagcatcggacaagccagtggggatcttctgagacagattggagagaatgagactgatgagcgattccaggatgttttaatgagtttggccaaagctgttgccaatgcagctgccatgttggtactaaaggcaaagaatgttgcccaagtggccgaagacactgtcctacagaacagggtaattgctgctgccacccagtgtgccctctccacctcccagcttgtggcatgtgccaaggttgtgagccccactattagctcccctgtgtgccaggagcagctgattgaagcagggaagctggtggaccgctcggtggagaactgtgtccgtgcctgccaggcggccactaccgatagtgagctcctgaagcaggtcagcgcagcggccagcgtggtcagccaggccctccatgatctcctgcagcatgtgcggcagtttgccagccgaggcgagcccatcggccgctacgaccaggctactgacaccatcatgtgtgtcaccgagagcatcttcagctccatgggtgacgctggtgaaatggtgcgccaggcgcgggttctggcccaagccacatcagacctcgtcaatgccatgaggtcagatgcagaagccgaaatcgacatggagaattcaaagaagctcctggcagcagcaaaactcttagctgactccactgctcgcatggtggaagctgcaaagggggctgcagccaacccagagaatgaggaccagcagcaaaggctgagagaagctgcagaaggcctccgggtagcaaccaacgcagctgcccagaatgctattaagaaaaaaattgtcaaccgactggaggttgcagccaagcaggccgcagcggcagccacacagaccatcgccgcctcccagaatgcagctgtttccaacaagaaccctgcggcccagcagcagctggtccagagttgcaaggcagtggctgatcacatccctcagctggtccagggagtgagggggagccaagctcaagctgaagacctgagtgcccagctggctctcatcatctccagccagaacttcctccagcctggaagcaagatggtgtcctctgccaaagccgcagtgcccaccgtgagtgaccaggccgcagccatgcagctgagccagtgtgccaagaacctggccaccagcttggcggagctgcgtaccgcctcgcagaaggcccatgaagcttgtggtccgatggaaatcgattcagctctgaatacggtgcagacgcttaagaatgaactgcaggatgccaagatggcagccgtggagagccagctgaagccacttccaggggaaacgctggaaaaatgtgctcaggacctgggaagcacatccaaggcggtgggctcctccatggcacagctgctgacctgtgctgctcaaggcaacgaacactacacaggggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcagacaaaagaagaccagatccaagtgatagggaacctcaagaatatctcgatggcatccagcaagctgctgttagctgccaagtctctctctgtagatccaggagctcccaatgcgaaaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctctgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgcaatgcctgccgcatcgcctcatccaagacggccaacccagtagccaagaggcacttcgtccagtcagccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttaccctgcagaggctgtttcagctcacacagagtcatccacacaaacccacggctcccagttgacagtcagtggaatgctcgtctccttagcgtccagggtggggattctgctggaataaagagcttcctcagtgactcatctttaggtcccacgctggtttctgtgccttcagaatggtcacaagcccggattggaaaggatctgcttacaaacctgtcccctgtcctccaacccaaaacgcctttttttctgtcttaatatccagaaaatctaaatgcatcctaaaatcaatgtgaacctttaacaagatagttttacttattatcacataagacataagatgttttcattttctggatgtcacacttccagaatttcatatttttcccctcttttctttccccttttcagagccctcccataggaagggaagggcttgaatttacccttaatctgcacctttagccaaggcagtgcatggaagatgaatggctcgtgggacagaatctaatgccagggagcaggagtgtttgaaagaattcatagtggggaaggtaaaagttaatggaagtacatgattttcaaaactggtaacagttaaaggcactcaccctccgcctctctctctctctctctctctggtgtgctatcatgtcttggactccatccacactatagtttcaaagttccactgacgggggaaagttggtgctttggtcctccgaagatgtcacctttcgaccttgcccgatcttgtttcaccagactctagcccatgtcatggttttaaaatacataaacttctgacagcttcccatatttataagttacttataagtgctgcacgtattagaatttttttttttcagaccagtaaagttagagaaaagacgctgtaaaggaaaagcaagtgagagtatgtgtaggacactgacagtgtgtgggcaccagttctgaagaggaggggagctgctggagccctagcctgttggggaaaagctggcacactcttggctcgccctctttgagtggagctgatccaacacctcatgcctgccttggccggacactgagaggaggggcacacgtgcttccagagacactcaggagtcagaccccaatgctcagagtcacaatgtgttcatggcctcctgtaacaggactctggggatcccctctgtggcccagcccaccccaccctctgctcttctatgctgtgcccagggcagctgccctcttctgcctgtgccccatcccatcctgaaaacccaggaccaaggcaggggcaggcagccagttcttccaccttgcctcagagtcatttaaaacctttactgcatttgataccagaaaagcctccagagacaaaccaaatgcaaaggcctttcctttataactctaaagaacaggcatcgaaagtttatttttgtaggagctatataaatactcacctttctggagtcgtccagtgctgggagctttggggagtttggttctcagttatcacctggtatggtcccagtttctcatctgtcctttcctcatccaccctgcacatgtgtatgtgaacggcttcgtggccggtgtggtggtttctcatttcataagatagttgaagggccatgccttgtctggatgttatttaataggcactactgcggtgtcctcagatggtactgagggggccttctggtccttcaaaggaaaataacacaggcatgagttcatttgggagtgtgaactttcagaacacctaataagagagtggtgtcagagtaaaaacggccccaggtctggagcatagaagtgtatctctgtgaagagagagccggtgtgttgacatgtggttcttctcacacccctctactcctcgagggctttgaatccttgggctgatttttgtgccagaaattgctgttcccgatggccaaaaggggaacctgaactggatttcagaactgcccagtgatttgaaaatttagattttacttgggcctttcaggagtctttagatagggatgctgaggtcatatttagttcaatgaacagcccttgtttaagttttgccagtgtccagccagctgtggccctggccatctgtgcaggcaggttcctcaattcctggttggccctgcagtcggtcaacacagtccctccaggtcggctgcagaggcagctgcccagcctgcagtctatgcacgggccttaagaaatgagctgcctgtagcctcacggcatatgcttttatcagggaaaacccttcgagcttcttctgattctcacctgcttgctttctggctgtcttagtcagtgtgtttacaggcaactaaagcctgttcctaatttatcaaaaaattataaccaaaattcaccatagcctaagagagtaaaccccacctccaaagtgatgccaaggccaaaacctcatcaaggaaccagacacaggtcaaaagtggtgagcaagccatggtctctgctcctggggaactcacacgctgacccccgaggagccttggtttcctccctggcagatagtccccagaatcttctctcccagctttgaggttctgggctctggaaaggcctctgggatgctggccttaagatctcagcacagactatcagcatgttccattctcagattcctggaggaaaggtaccctctgttgaccaaggggctggctgcttctgagacttaccaacccaagaaatttggagacattcccctcaggctaaaaggcagcggtccccagagttcagaaagcaaaagatcttgacaactgtgccagtagtggctctggtcctatctctccacagtgctggcctctgctggggaaggcatctttcccaaaggtatccccaagtaccatgttgaaaatgtcctcagtctgttgctccatctttctgagcctctgcttggtatgtcatgtttatggtcactacggatgagtgtgtgcagagtttgggttgattcttttaaatgctacaaacaagagctatttcttttcaataaaaaaggtttggattcggcctcttcctctgagcccacctcccagccctccagggagcatcagtgtacctgagtcactttgtctgcatctcttcatcccacaaaacacgaggctgggtctcattcagcggcctctcaccaaccttcaagatccagaagaaaacaggaacgttcagctctgccctgtgtcgtatctaatcacatacattaatttatctaaccacataagttatttttttttatttgccagaaataaacctttaaaggaacaaa

SEQ ID NO: 189077 - DNA, 5155 bp, Homo sapiens
  Payload ID: 17341
  Gene Symbol: TLN2
  Gene Name: talin 2
  ENST ID: ENST00000494733
  CDS Start-End: 1-4416
gaaaaatgtgctcaggacctgggaagcacatccaaggcggtgggctcctccatggcacagctgctgacctgtgctgctcaaggcaacgaacactacacaggggtggctgctagagagacggcccaagctctgaaaacactggcccaggccgcccgtggagtggctgcatcgacaaccgaccccgcggccgcccatgccatgttagattctgctcgagacgtgatggagggctccgccatgctcattcaagaggccaagcaggccctgattgcacctggagatgcagagcgtcaacaaagactggctcaggtggctaaagccgtctcacactccttgaataactgcgtaaattgcctccctgggcagaaggatgtggacgtggccttgaagagcatcggggagtccagcaagaagctgcttgtggattcgctacctccaagcacgaagcctttccaggaagcccagagtgaactgaaccaggcagcagctgatctgaaccagtctgctggggaagtggtccatgccacccggggccagagtggagagttggctgcagcctctggaaagttcagtgatgattttgatgaattcctcgatgctggcattgagatggctggccaagctcagacaaaagaagaccagatccaagtgatagggaacctcaagaatatctcgatggcatccagcaagctgctgttagctgccaagtctctctctgtagatccaggagctcccaatgcgaaaaatctcctggctgcagctgcaagagctgtgacagagagcatcaatcaactcatcactctgtgtacccaacaagctccgggccagaaagagtgcgataatgccctgcgggagctcgagactgtgaaggggatgttggacaatcctaatgaacctgttagtgacctctcttactttgactgcattgagagtgtgatggaaaactccaaggttctgggtgaatcgatggcagggatttcacagaatgccaagaccggagacctccctgcctttggggaatgtgtggggattgcatccaaggctctctgtgggctgacagaggctgcagcccaggctgcatacttggttggcatctctgatccaaacagccaggcaggccaccagggcctggtggaccccatccagtttgccagggctaaccaggccatccagatggcatgccagaacttggtggaccctggcagcagcccatcacaggtcctgtcagccgccacaattgttgccaagcacacgtcagccttgtgcaatgcctgccgcatcgcctcatccaagacggccaacccagtagccaagaggcacttcgtccagtcagccaaggaagtcgccaacagcactgccaacctggtgaagaccatcaaggccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggagatcggattccagattcgcactcgtgtgcaggacctgggccacggctgtatcttcctggtgcagaaggcaggggccctccaggtctgccccacagacagctacaccaagagggagctgatcgaatgcgcccgtgccgtcacggaaaaggtctccttggtgctctcggctctccaggccgggaacaaaggaacccaggcatgcattacagccgccaccgctgtgtctgggatcattgccgacctggacaccaccattatgtttgcaacagcggggacgctgaatgcagagaacagtgagaccttcgcagaccacagggagaacattctcaagacggccaaggccttggtagaagacacgaaactacttgtgtcaggagctgcgtccactcctgacaagctggcccaggcggcccagtcctcagcagccaccatcacccagctcgcagaagtggtcaagctgggggcagccagcctgggctccgacgaccccgagacccaggtggttttgatcaatgccatcaaagatgtggccaaggccctttctgatctcatcagtgctaccaagggagctgccagcaagccagtggacgacccttccatgtaccagctcaagggggctgccaaggtgatggtgaccaatgtcacctcgctcctcaagactgtaaaggcagtggaggatgaggccacccggggcaccagggcgcttgaggccacaattgaatgcataaagcaggagcttacggtgttccagtcaaaagacgtacctgaaaagacatcatcacctgaagaatccataaggatgacgaaaggcatcaccatggcaacagccaaagccgtggcagctgggaactcatgtagacaggaggacgtgattgctactgccaacctgagccggaaagccgtgtcagatatgttgacggcttgcaagcaagcatccttccaccccgatgtcagtgacgaggtgagaaccagagccttgcgtttcgggacggagtgcacccttggctacttggacctcctggagcacgtcttggtgattcttcagaaaccaaccccagaattcaagcagcagctggccgctttctccaagcgagtcgccggcgctgtgacagagctcatccaggcggcggaagccatgaaaggaacagagtgggtggatccagaagacccaactgtcattgcagaaacagagttactgggggctgcagcatccatcgaagctgctgctaagaagttagagcaactgaagccaagagcaaaaccaaaacaagcggatgagaccctggactttgaggaacagatcttggaagctgctaaatccattgctgctgccacaagcgccctggtcaaatcggcctcagcagcccagagggagctggtggcccaaggaaaggtgggctccatccctgccaatgctgcagacgacggacagtggtcacaggggctgatttctgctgcccggatggtggcggctgcgaccagcagtctctgtgaggcggccaatgcctccgttcagggacacgccagcgaggagaagctcatctcatctgccaagcaggtcgccgcttccacggctcagctgctggtggcctgcaaggtgaaggccgaccaggattcagaggccatgaggcggctacaggtaatggtcactgatgctggtgggaaaatactcctgttggagcgggcggcaggaaatgctgtgaaaagagcctcagacaatcttgtccgtgcagcccagaaggcagcttttggcaaagctgatgacgacgatgttgtagtgaaaaccaagtttgtggggggcattgctcagatcatcgccgcccaggaagaaatgctaaagaaagagcgagaactggaagaagcaaggaaaaaactggcccaaatccgccagcagcagtataagtttttacccaccgagctgagggaagatgagggctaaaggtgcgagcccagatggcgagccccaggggatggccctggctgaactggacagacagtgttcctgagaggctgggcacttagctggaaaccgcccacctccctcccgggtgagcctggagccctgcgtgcttgttctcacatctctgtcccgtcggcactggctgcatgatcgtgatgtcacacggtacaatgtcctacccacaactcctctgccgcctcccctcatgcctcaccgtgtctcaggagagaggggtgcacgtttcatggactgttaccaacaaagaaaagtcagtattatgttgttctcagacactttggcttttgttggtccttctcttaggcctgctcctggacctctttatgatattgtgatagggaaaaaaatcattgacgtcatagaatattcttcttcctctcaggagaagacggaagctggagttggacatggttcataaaagccagaaacacaaacccgtgtggactccgggagggtgactcaggtcctccttccatgtcttgagcactggctcacccagggggtgaaaaattcccgcccctgtttgcacgctttcttgcctccgtgtgtaagctccttgtacaacccagacccatcttgtattttgtggcccagaaaactgaacgattattttgttcctccgtagtccaaagggcagagttgcggaaggccgtcggggcttggtgagcaggggctgtaatacagtctgtgggctccttac

SEQ ID NO: 189078 - DNA, 2116 bp, Homo sapiens
  Payload ID: 17341
  Gene Symbol: TLN2
  Gene Name: talin 2
  ENST ID: ENST00000472902
  CDS Start-End: 254-1246
gcaattaagcactttcagtgtgtaccacagacacccgatccagctctctttaatcgaatttgacttggctgccctggatggggatttctctgaagacaaccgcaataagtgtcgcatcgccaccgcacccttgattgaagctgtggagaacctgacagcgttcgcctcaaaccctgagtttgtcagcattcctgcccagatcagctccgagggttcccaggcacaggaaccaatcctggtctcagccaagaccatgctggagagttcatcgtacctcattcgcactgcacgctctctggccatcaaccccaaagacccacccacctggtctgtactggctggacattcccatacagtgtccgactccatcaagagtctcatcacttctatcagggacaaggcccctggacagagggagtgtgattactccatcgatggcatcaaccggtgcatccgggacatcgagcaggcctcgctggccgccgtcagccagagcctggccacgagggacgacatctctgtggaggccctgcaggagcagctgacttcggtggtccaggaaatcggacaccttatcgatcccatcgccacagcggctcggggagaagcagctcagctgggacataaggtgacacaactggcaagctattttgagcccttgatcttagccgcagttggtgtggcctccaagattcttgatcatcagcagcagatgacggtgctggaccagaccaagactctcgcagagtctgccttgcagatgttgtatgcagccaaagaaggtggcggaaaccccaaggcacaacacacccatgacgccatcacagaggccgcccagttgatgaaggaagccgtggatgacatcatggtgacgctgaacgaagctgccagtgaagtggggctggttgggggcatggtggacgccattgcagaagccatgagcaagctggatgaaggcactcctccagaaccaaagggaacatttgtcgactatcagacgactgtggttaaatactccaaagccattgcggtgacagctcaggaaatgatgactaagtcggttactaacccggaggagttgggaggactggcttcacaaatgaccagtgactatgggcacctggctttccagggccagatggcagcagccacggcggaaccagaggaggtctgccaccttaagacccctattttaagatgcacacacacactggtgcccactcctgggtatttcttcatagcttagctccactctggaagaccccagcccagtaaccagagcccagtttatttccccaccactgcacagcacaggtccagaccaggtagccccaggctgtactcaagtctcactgccccttatggggcagactggccaagaactggggcatgggctttcagacagaaggactttgtatacagtgttctatcaggtcccctgtccctagccctgtcacctgtctcttttagcatgcccaagcttgggactgccatcttatcacttcctactccagttagcacatcccccgcaattatttttgttttccataggttcacagaagtgttgaaagattcaagtatgaaaattagctatccctctccctcgaaagagctactttcatgaaacaaagtcttgcctgaatattctgggtggctaagaattagcccagacatacctcctgtggactccttttattacttccctgcctttcctagaccagctttccttagtggccagtgtagacttggctttagaatgcctgtacccgtaagagtctaacggtagccaaagttgggccccaaaggccactttctaagagctgccatctctcatacttctaatggggtggtccattgggaaggacacaggtcatgtgtggctccaaggagctttgtagcatctatatcagtgtgaacacatagaaggagtccagggcttgggggaaccacatggcttcttagagaaaggaagcccaatttaaaatgaagattaatggagtggattacagggacacttaaaagataaaagtaattatattctgtgaaattcagcaagctgtttattgagcgcaaaccatgttcgagacgttcctaaatgaactgagttgtcaaggca

SEQ ID NO: 189079 - DNA, 1297 bp, Homo sapiens
  Payload ID: 17342
  Gene Symbol: TAMM41
  Gene Name: TAM41 mitochondrial translocator assembly and maintenance homolog
  Uniprot ID: Q96BW9
  ENST ID: ENST00000273037
  CDS Start-End: 284-1234
gaagcgcctgtgcgtgcgtggggcgtagcaagggacggaagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactaggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacagaa

SEQ ID NO: 189080 - DNA, 1619 bp, Homo sapiens
  Payload ID: 17342
  Gene Symbol: TAMM41
  Gene Name: TAM41 mitochondrial translocator assembly and maintenance homolog
  Uniprot ID: Q96BW9
  ENST ID: ENST00000444133
  CDS Start-End: 144-1502
agtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactagggctttcagcaatcgtgagaccgtctagtataagacagagcacgaaaggcatttttactgctggtaagagctttggaaatccgtgtgtaacatacctgctgactgagtggcttccacactcttggttacagtgtaaagctttgtatcttttaggtgcttgtgaaatgctgagctttgatggccataaactgggatattgcagtaaggtacaaacaggcataacagcagcagaacctggtggtcgaacaatgtcagaccattggcagtgctgttggaagctttactgcccttctgaattttctgagacacttcctgtgtgcagggtttttccctcatattgttttatttatcaaagttacagatgcataggattgcaaaaacagcagcatctgtgctccccctcctcttccccttctctgagacaactgcttccatctgtcttagtgggttatttttgttgttactgccatttctctaaatggtaagttttcgttgctccttctctacgtttcaactttaggtatcatctattgacttctctctatgggaggttagaagtcaactctggcacccaccctcatcaaatgtacgcaccctcccat

SEQ ID NO: 189081 - DNA, 992 bp, Homo sapiens
  Payload ID: 17342
  Gene Symbol: TAMM41
  Gene Name: TAM41 mitochondrial translocator assembly and maintenance homolog
  ENST ID: ENST00000417723
  CDS Start-End: 250-573
acggaagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagtcatatctgacggcagcttccagaacatgctggctcccatatccacagagcactttcctccaacacggctccctacccttccctgtgcttcccccagtgcttccagcaagtctgtttaactcacgtgtccttcaagactcagatttgtcatctctaggagaatttctccctcctgtgcccctgatctgatccctatgctgagtgcaaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggcctctctggcagtgtcccaagagttcactggcttttcactctgaacaacaaataacagtgctgctgagacaagttcctagttcacctttcattgaagaaccagatcagcacagtagcagaatctt

SEQ ID NO: 189082 - DNA, 1078 bp, Homo sapiens
  Payload ID: 17342
  Gene Symbol: TAMM41
  Gene Name: TAM41 mitochondrial translocator assembly and maintenance homolog
  ENST ID: ENST00000411947
  CDS Start-End: 257-712
gcaagggacggaagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggcctctctggcagtgtcccaagagttcactggcttttcactctgaacaacaaataacagtgctgctgagacaagttcctagttcacctttcattgaagaaccagatcagcacagtagcagaatcttccgaactgacatttttcctttgaggtctcaactgtgtctttcaggctggagtgtagtgtcatgatcatggctcactgcaacccactgcagcctcaaccacctggactgaagctgtcttcctacctcaacctcctgagtatctgggaccacacatgtgcatcactgtgcctggctaggtgaaaattatctcagtgaacgaggatgtcactcttagatcagccctcgatagaaatctgaagagtgctgtgaccgctgctttcctcatgctccccgaaagcttttctg

SEQ ID NO: 189083 - DNA, 1213 bp, Homo sapiens
  Payload ID: 17342
  Gene Symbol: TAMM41
  Gene Name: TAM41 mitochondrial translocator assembly and maintenance homolog
  Uniprot ID: Q96BW9
  ENST ID: ENST00000455809
  CDS Start-End: 137-1150
ccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactagggctttcagcaatcgtgagaccgtctagtataagacagagcacgaaaggcatttttactgctggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacagaa

SEQ ID NO: 189084 - DNA, 648 bp, Homo sapiens
  Payload ID: 17342
  Gene Symbol: TAMM41
  Gene Name: TAM41 mitochondrial translocator assembly and maintenance homolog
  ENST ID: ENST00000414736
  CDS Start-End: 1-167
gtgactttcggatggtggttggagaagataaaacaaaagtgttgaatattgtgaagcccaatatagcccactttcgagagctctatggcagcatactacaggaaaatcctcaagtggtgtataaaagccagcaaggctggctggaggtaactgtatgtggaaaatagcttgtattgtttctaagacaaaggctatttgcaggaagaaagtcaggggtagaacagcatgactggtgtgagaacatttatagtttaaaaaagccggatatctcactcttttgctagggctgatgttgaatttttgtgctcaagcaattctcctgcctcagcctcccaaactgttgggattacaggtgtgaacctgtgctcctggcccatttgatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactagggctttcagcaatcgtgagaccgtctagtataagacagagcacgaaaggcatttttactgctggcctgaagaagtcagtgatttatagttcactaaaactgc

SEQ ID NO: 189085 - DNA, 2558 bp, Homo sapiens
  Payload ID: 17342
  Gene Symbol: TAMM41
  Gene Name: TAM41 mitochondrial translocator assembly and maintenance homolog
  ENST ID: ENST00000457498
  CDS Start-End: 246-701
aagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggcctctctggcagtgtcccaagagttcactggcttttcactctgaacaacaaataacagtgctgctgagacaagttcctagttcacctttcattgaagaaccagatcagcacagtagcagaatcttccgaactgacatttttcctttgagtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactaggtacgtttatgaatttgatgttgaggaaatgccagccatggggaaaagcagactttgtttgtgattggaatgtattatttcttcctttttgtttagcgagatagagagattgcctctcagaagaagaaagcactaaaaatttgagggttttctaaatctgcatttttatttgtttgaagtaagatggtgaaaatacttctgtttttaaattcctggatcctaaatcactgtcaaagggagaaacaatgtttcttttggttcctagagcacaacttctagaatttatttaaaagatgtgtctgtgttttgtggtggtctgagaaaagagattggtggcatttttttgtgcttttataacatcgagaacacagctttcctcaatcaactccatttgatgtgtctcatacattgttgagtacattccctcagacatggcccacgttccacagcattttccccagcactgccctgatgtttatccaaaactctgaacccaggccaggtgcagtggctcacgcctgtactcccaacactttaggaagtccaggagggagaatcacttgaggccaggagtttgagaccagcttgggcaacagagcaagaccctgtctctgcaaaaattacaaaagtagctgggcatggtggcacatgcctataatctcagctaacttgggagtctgaggtgggaggatcgcttgagcagttggaggctgcaatgagctaggatcgcaccactacactccaggcttggtgatagagcagcccgtatctcttaaaaaacaaacaaaaaaaagagcctgaaccttatcttcagagactaacttccctttaaggtgctaaagtaaatatttactgagctcctccgcgtgccagatagaatttccagtaatgctttgcaaagaccatcgcactgcagtggatgagctgcagcaggcgctccacgcccactctcctcctgggcctgcactaggtttgcagagtgtgtgtttaggtcaccagctccccatcctgaagatagctctgtacgaggcacactgttgtttgtttgaacatgatcctggcaacagtgtgatctgggccgtctctttgagggctttcagcaatcgtgagaccgtctagtataagacagagcacgaaaggcatttttactgctggcctgaagaagtcagtgatttatagttcactaaaactgcacaaaatgtggaaagggtggctgaggaaaacatcctgattttgcttgcttttatatatgttatgtgtagatgaataaagtgtttgatcctttttgac

SEQ ID NO: 189086 - DNA, 1078 bp, Homo sapiens; identical to SEQ ID NO: 189082
  Payload ID: 17342
  Gene Symbol: TAMM41
  Gene Name: TAM41 mitochondrial translocator assembly and maintenance homolog
  ENST ID: ENST00000625087
  CDS Start-End: 257-712

SEQ ID NO: 189087 - DNA, 1102 bp, Homo sapiens
  Payload ID: 17342
  Gene Symbol: TAMM41
  Gene Name: TAM41 mitochondrial translocator assembly and maintenance homolog
  ENST ID: ENST00000623275
  CDS Start-End: 246-701
aagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggcctctctggcagtgtcccaagagttcactggcttttcactctgaacaacaaataacagtgctgctgagacaagttcctagttcacctttcattgaagaaccagatcagcacagtagcagaatcttccgaactgacatttttcctttgagtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggag

SEQ ID NO: 189088 - DNA, 992 bp, Homo sapiens; identical to SEQ ID NO: 189081
  Payload ID: 17342
  Gene Symbol: TAMM41
  Gene Name: TAM41 mitochondrial translocator assembly and maintenance homolog
  ENST ID: ENST00000623389
  CDS Start-End: 250-573

SEQ ID NO: 189089 - DNA, 258 bp, Homo sapiens
  Payload ID: 17342
  Gene Symbol: TAMM41
  Gene Name: TAM41 mitochondrial translocator assembly and maintenance homolog
  ENST ID: ENST00000624342
  CDS Start-End: 1-167
gtgactttcggatggtggttggagaagataaaacaaaagtgttgaatattgtgaagcccaatatagcccactttcgagagctctatggcagcatactacaggaaaatcctcaagtggtgtataaaagccagcaaggctggctggaggtaactgtatgtggaaaatagcttgtattgtttctaagacaaaggctatttgcaggaagaaagtcaggggtagaacagcatgactggtgtgagaacatttatagtttaaaaa

SEQ ID NO: 189090 - DNA, 844 bp, Homo sapiens
  Payload ID: 17342
  Gene Symbol: TAMM41
  Gene Name: TAM41 mitochondrial translocator assembly and maintenance homolog
  ENST ID: ENST00000623848
  CDS Start-End: 137-844
ccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggag

SEQ ID NO: 189091 - DNA, 851 bp, Homo sapiens
  Payload ID: 17342
  Gene Symbol: TAMM41
  Gene Name: TAM41 mitochondrial translocator assembly and maintenance homolog
  ENST ID: ENST00000624236
  CDS Start-End: 144-851
agtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggag

SEQ ID NO: 189092 - DNA, 991 bp, Homo sapiens
  Payload ID: 17342
  Gene Symbol: TAMM41
  Gene Name: TAM41 mitochondrial translocator assembly and maintenance homolog
  ENST ID: ENST00000624386
  CDS Start-End: 284-991
gaagcgcctgtgcgtgcgtggggcgtagcaagggacggaagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggag

SEQ ID NO: 189093 - DNA, 607 bp, Homo sapiens
  Payload ID: 17342
  Gene Symbol: TAMM41
  Gene Name: TAM41 mitochondrial translocator assembly and maintenance homolog
  ENST ID: ENST00000630288
  CDS Start-End: 284-607
gaagcgcctgtgcgtgcgtggggcgtagcaagggacggaagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagtcatatctgacggcagcttccagaacatgctggctcccatatccacagagcactttcctccaacacggctccctacccttccctgtgcttcccccagtgcttccagcaagtctgtttaactcacgtgtccttcaagactcagatttgtcatctctaggagaatttctccctcctgtgcccctgatctga

SEQ ID NO: 189094 - DNA, 4708 bp, Homo sapiens
  Payload ID: 17343
  Gene Symbol: TC2N
  Gene Name: tandem C2 domains, nuclear
  Uniprot ID: Q8N9U0
  ENST ID: ENST00000340892
  CDS Start-End: 315-1787
ggccgcgcgaggtgaccggagtcacagttcccgcaggcggcgacagcagagcgcccactgcctccagcaggtaaccggccgcggccgcgcggcgccggcccagcgcgggcgtgggacgtggagacccggaggagggcggcgggacccgggcggggaaaggcgcggcgtggcttggctcaggtgcgcttctcccacctggcagctcgctcagggctgtggggggtgcctgtgagggcggccccgccttgcgggctggagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgttttcgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaa

SEQ ID NO: 189095 - DNA, 3751 bp, Homo sapiens
  Payload ID: 17343
  Gene Symbol: TC2N
  Gene Name: tandem C2 domains, nuclear
  Uniprot ID: Q8N9U0
  ENST ID: ENST00000360594
  CDS Start-End: 134-1606
gaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgttttcgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaa

SEQ ID NO: 189096 - DNA, 5146 bp, Homo sapiens
  Payload ID: 17343
  Gene Symbol: TC2N
  Gene Name: tandem C2 domains, nuclear
  Uniprot ID: Q8N9U0
  ENST ID: ENST00000435962
  CDS Start-End: 325-1797
gtcaagtggtgttagcaatcacatcagcaccaaatggctcaggatgctctggtttcaaagcttataaaacagagggtgattcccttgggactcactcagctcggctccgaaaagcaaaggccagaaggcagcagtgagcctgggtccctgctgtgtagggagactcaggggctgggaagaaggatggaatcagaaatgctgaaggtttacgtgagctttgcaccgagcgcctccgaaccactgcctctgggctcaacagaacacagggattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgttttcgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttagttttaagttttttaatctataaaaaatgtgatttctataaaccatgattacaataaataattatattaaa

SEQ ID NO: 189097 - DNA, 902 bp, Homo sapiens
  Payload ID: 17343
  Gene Symbol: TC2N
  Gene Name: tandem C2 domains, nuclear
  ENST ID: ENST00000556590
  CDS Start-End: 1-729
agaagcctggatacaattactctatcaggagatgaaagggactttgggagactgaatgtgaaattgttttataattcttcagtagaacagatctggatcacagttttacaggctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaatttt

SEQ ID NO: 189098 - DNA, 1770 bp, Homo sapiens
  Payload ID: 17343
  Gene Symbol: TC2N
  Gene Name: tandem C2 domains, nuclear
  Uniprot ID: Q8N9U0
  ENST ID: ENST00000556018
  CDS Start-End: 213-1493
gggagtgggtacggggagggaagtggaggggagggggtaagtgatagggtaggggaggccctgggaaaggcaggacctcgaggcgcggccgcgcgaggtgaccggagtcacagttcccgcaggcggcgacagcagagcgcccactgcctccagcagattaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtg

SEQ ID NO: 189099 - DNA, 4708 bp, Homo sapiens; identical to SEQ ID NO: 189094
  Payload ID: 17343
  Gene Symbol: TC2N
  Gene Name: tandem C2 domains, nuclear
  Uniprot ID: Q8N9U0
  ENST ID: ENST00000620359
  CDS Start-End: 315-1787

SEQ ID NO: 189100 - DNA, 4878 bp, Homo sapiens
  Payload ID: 17343
  Gene Symbol: TC2N
  Gene Name: tandem C2 domains, nuclear
  Uniprot ID: Q8N9U0
  ENST ID: ENST00000610758
  CDS Start-End: 57-1529
attaatattaagattggaagtttgtgtcttttgctggatattggaaattgaatgtaatggcaacagaatttataaagagttgctgtggaggatgtttctatggtgaaacagaaaaacacaacttttctgtggaaagagattttaaagcagcagtcccaaatagtcaaaatgctactatctctgtacctccattgacttctgtttctgtaaagcctcagcttggctgtactgaggattatttgctttccaaattaccatctgatggcaaagaagtaccatttgtggtgcccaagtttaagttatcttacattcaacccaggacacaagaaactccttcacatctggaagaacttgaaggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttgaagacttcacacattaatttggtgaagaacttgacattcttttagaagacttatgatttcaatttgctaccaatgagaagaggcaaatcaacaaatttgtcaatttatgggggctataattatggtatataatgtatctgatagaaaatttgataagaaaatgtaatgaattttatcagatatccaaagtaaaggaaatgttttaaaactgcaacaagagacacagacagtaaaatcaaagtattattaggatgactaaataaattataaagtctgtgagaatatcaaccatagatagttctttctatattatgttttcgcttttgtattttaagctttacttagatattcaaaacctggtatatcaagtctctgttagtactattggcatttagaagactttaccattatttcagtgctaggcattattgattaggtcttggctccactgtttacctcttgctatgtattttctcccggtaaaaatgaattgaaccatttcaactattttctatatttggagaaagtttgtgccctgtgttttataatttttttacccataagacatcacattatccctttgtaagctacttatctccaaaaaacttcagaaatagaaaactacattttggcaggaataattgaaaacaccagaaggttgaagtttaattggaaacccagaatatacatactttgctgttttcttccctcaaatattttactatttgttttatttggagttaaaataagagtatcatccatatggtccatcctaattcacagaattaaatgagcttaaatagaaaattcagtattttatgataatcacttcgtttttagtttttaaaatttagattattctataatttaccgtgtttgagtattttctcatttttttcataaccatacctgattatactgtgtaacaaatattttctattgcagttttctttccagtacttattagaactcagtatttggaaataatttcagcttaattgaccataagaactgtggccaaaaagaacagttttttggagaggcagatgacattatacctgattttagaaaatctcactttatttttgctaataagtagactaagtgctctgtgttctcagtcttccctttttttctgcccccattcttactttgtcccaggcatgcagagaaagatggtgatattttaggccaggagtataccttgctataacctaagcatgccttctttattccagctcctatgttctgtgtatatcattaacattttcccaaataaacacttaattctcttttccctaggtgccatctcctcaagctacaaaatgtccacatcttatatcccctttgcttctactgctctgattttgtggtaccagtactctctgccactgaacattttgaaatatttttgttttagatttgcaaaaaatgacatataggtcagtactcacatggatttttaagataaatcacctgtgtgataatattttgaatctgagacgaatacaacttttaaaaattgtttttaaaaatagacttttttttttagagcagttgtaggttaacagaaaaattgagaggaagatagagatttcctttctcccctgacaaagccctcaacagcctcccaggctatcagtatcctgcaccacaatggtacatttgttacaatcaatgaacctactctgaaacatcattatcatccaaagttcatggtttacattagagtcccctcttggtgttatacatgctagaggacaaatatatgatgatatgtatgcatcattataatatagtatagtttcgctgccctaaacatcctctgcaaatgcaactattttaatgggtaccaaagaagtaaatgtatttactggcttttagataataaataacgggctttattgtttattttaaaagctacaatttgttttagctggtttctctgttctattaatgctttgaatttccaaatttaatatatgtagtcatgcatttaacttaatatttaattatttgatttatttaattttctatattcttacaatgtatgtatgatgtataatttaagggaaagctatgacttctcagtttcttagaatcctaggtaaataaaacaataaaaagaaaacccttacatttaaaagagctttcaggtacagaagtattgatacaactaagatcctaaatgttttaattagtgtttacttaagcctttttcaggtgaggaggtactaatgctggttatttccttgaagctttatgtggacctataaataaaaatccaatctcctgctaataggtatgcatattgtgagaaaaacgttaggagctggtagtaaaaaatgagattctatgccaaaataacttctcttcatatttgcctaggcatttcttgacctttacccacttacgcaaggagaaggaaatcataatgatgtcatgtgatcaaaggaaaccatggaagggttcacgctgatagctgatagcttttacagtgctcattcctaacagtggatttacttgtaagctttcagatcaacacaaatagctgcagcctgggttaaaatataacatcactatttggcttttgttttgcatgatttttaaaagcagtactcctagggaaatggcctctgaagtatatcagtttcatctcttaccaagactgttaagaagaaactagtgggattttgaacaagttatataattgtggtctgaaaagaccctaaactgaagttctgtttaaatatagttacatgaatttctctgatactaatgtactcaacagccaggtataaactatatctcctagtaacattttccatttttgtttaatcaaatacttgcttatgaaggatttcagaaatttgtaataaatgtcagcttttgatagcatagcagtaattgacatttcaaaaatatatatttctttctgtgtttggttgggtgtaatgaggaaaatacctgataaaatgtctgaagacactttctaatgttatcttggtgcataagctgtaatttttattcaaaattaaatttcaaatgtttgcagttttggctaaaacattgagttgaaagaattatgaaaagtgggcccatatgaagtaccatgttcattttgaaatatagatttaagatttagaaatatattaaaagagttaatggagcctcctaaattggattttattttgtgggtgaagaattgtaggaagatgaatgtggcctacagttttagtaatctcctagtggagttttttttaacttagtacttttttagttttaagttttttaatctataaaaaatgtgatttctataaaccatgattacaataaataattatattaaa

SEQ ID NO: 189101 - DNA, 3751 bp, Homo sapiens; identical to SEQ ID NO: 189095
  Payload ID: 17343
  Gene Symbol: TC2N
  Gene Name: tandem C2 domains, nuclear
  Uniprot ID: Q8N9U0
  ENST ID: ENST00000632584
  CDS Start-End: 134-1606

SEQ ID NO: 189102 - DNA, 902 bp, Homo sapiens; identical to SEQ ID NO: 189097
  Payload ID: 17343
  Gene Symbol: TC2N
  Gene Name: tandem C2 domains, nuclear
  ENST ID: ENST00000633527
  CDS Start-End: 1-729

SEQ ID NO: 189103 - DNA, 1770 bp, Homo sapiens; identical to SEQ ID NO: 189098
  Payload ID: 17343
  Gene Symbol: TC2N
  Gene Name: tandem C2 domains, nuclear
  Uniprot ID: Q8N9U0
  ENST ID: ENST00000634120
  CDS Start-End: 213-1493

SEQ ID NO: 189104 - DNA, 3256 bp, Homo sapiens
  Payload ID: 17344
  Gene Symbol: TBK1
  Gene Name: TANK-binding kinase 1
  Uniprot ID: Q9UHD2
  ENST ID: ENST00000331710
  CDS Start-End: 340-2529
aatcccaattactgtgttcgctgctcagggctcctcattcccctttagagtaaagggcgagggcaacagtggacggggtgtctccagacatccccctcattaccgtggccgcggaagccgactcggcagttgccgccgcggctgtggtgactaccagacgggccataggcgtgcgcacgcgcacccgcaccggcgcgccggccgtcggtcacgtggcctccggccagggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaa

SEQ ID NO: 189105 - DNA, 419 bp, Homo sapiens
  Payload ID: 17344
  Gene Symbol: TBK1
  Gene Name: TANK-binding kinase 1
  ENST ID: ENST00000539810
  CDS Start-End: 275-419
ggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaatgccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaac

SEQ ID NO: 189106 - DNA, 513 bp, Homo sapiens
  Payload ID: 17344
  Gene Symbol: TBK1
  Gene Name: TANK-binding kinase 1
  ENST ID: ENST00000540417
  CDS Start-End: 220-513
atccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaattataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgtttta

SEQ ID NO: 189107 - DNA, 547 bp, Homo sapiens
  Payload ID: 17344
  Gene Symbol: TBK1
  Gene Name: TANK-binding kinase 1
  ENST ID: ENST00000538890
  CDS Start-End: 238-547
aagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctgggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatg

SEQ ID NO: 189108 - DNA, 5795 bp, Homo sapiens
  Payload ID: 17345
  Gene Symbol: TNKS1BP1
  Gene Name: tankyrase 1 binding protein 1, 182kDa
  Uniprot ID: Q9C0C2
  ENST ID: ENST00000358252
  CDS Start-End: 154-5343
gcggcggcggcggcggtagcagcggcggcggcggcggggactggcatcggggccccgagccgagcggagccggaccccgggcgagcgcgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacggaaggcccctgcccctttccgcccagcctcagagcgcttcgcggccaccacggtggaagagatcctggccaagatggagcagcctcggaaggaggtccttgccagccccgaccgcctgtggggttcccgcctcacctttaaccacgatggcagctcgcgatatggccccaggacctatggcacgaccactgctcccagggatgaggatggcagcaccctcttcaggggatggtcccaggaggggccagtaaagtctccagcagagtgccgggaagagcacagcaagacccctgaggagaggagccttccttccgacctggccttcaacggggacctggctaaggcagccagctcggagctacctgctgatatttccaagccctggattccctcaagtccagccccctcctcagagaatggaggccctgccagcccaggcctccccgcagaagcctcaggctcaggccctggctctccccatcttcacccgcctgataagagttctccctgccactcacagcttctggaagcccagactcctgaagcttcccaggcttctccctgccccgctgtgactccatcagctccaagtgcagccctgcctgacgagggctcccgccacacccccagcccggggctccctgccgagggggctccagaggcccccagacccagcagcccaccccctgaggtcttggagccccatagcctggatcagccccctgccacctcaccccggcccctgatcgaggtgggtgagttgctggatctcactcggacgtttccatctggcggggaggaggaggccaagggtgacgcacacctccgccccaccagcctggttcagcgccgattctctgaaggtgtgctccagtcacccagtcaggaccaggagaagctggggggctcgctggctgccctgccccaaggccaggggagccagttggccctggatcgtccctttggggcagagtccaactggagcttatcacagtccttcgaatggaccttccccacgaggccctcgggtctgggcgtgtggcggctggactccccgcctccctcccccatcactgaagccagtgaggccgccgaggctgctgaggctggcaacttggccgtttccagcagggaagaaggagtgtctcagcaggggcaaggggctgggtcagctccaagtgggtcaggaagttcctgggtgcagggggatgatccaagcatgtccctcacccagaagggcgatggggagagtcaacctcaattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccagggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaa

SEQ ID NO: 189109 - DNA, 4336 bp, Homo sapiens
  Payload ID: 17345
  Gene Symbol: TNKS1BP1
  Gene Name: tankyrase 1 binding protein 1, 182kDa
  ENST ID: ENST00000528882
  CDS Start-End: 179-910
gcagtggcttcgtcccgcggtgacggcggcggcggcggcggtagcagcggcggcggcggcggggactggcatcggggccccgagccgagcggagccggaccccgggcgagcgcgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacggaaggcccctgcccctttccgcccagcctcagagcgcttcgcggccaccacggtggaagagatcctggccaagatggagcagcctcggaaggaggtccttgccagccccgaccgcctgtggggttcccgcctcacctttaaccacgatggcagctcgcgatatggccccaggacctatggcacgaccactgctcccagggatgaggatggcagcaccctcttcaggggatggtcccaggaggggccagtaaagtctccagcagagtgccgggaagagcacagcaagacccctgaggagaggtgaagggtgggaggagccttccttccgacctggccttcaacggggacctggctaaggcagccagctcggagctacctgctgatatttccaagccctggattccctcaagtccagccccctcctcagagaatggaggccctgccagcccaggcctccccgcagaagcctcaggctcaggccctggctctccccatcttcacccgcctgataagagttctccctgccactcacagcttctggaagcccagactcctgaagcttcccaggcttctccctgccccgctgtgactccatcagctccaagtgcagccctgcctgacgagggctcccgccacacccccagcccggggctccctgccgagggggctccagaggcccccagacccagcagcccaccccctgaggtcttggagccccatagcctggatcagccccctgccacctcaccccggcccctgatcgaggtgggtgagttgctggatctcactcggacgtttccatctggcggggaggaggaggccaagggtgacgcacacctccgccccaccagcctggttcagcgccgattctctgaaggtgtgctccagtcacccagtcaggaccaggagaagctggggggctcgctggctgccctgccccaaggccaggggagccagttggccctggatcgtccctttggggcagagtccaactggagcttatcacagtccttcgaatggaccttccccacgaggccctcgggtctgggcgtgtggcggctggactccccgcctccctcccccatcactgaagccagtgaggccgccgaggctgctgaggctggcaacttggccgtttccagcagggaagaaggagtgtctcagcaggggcaaggggctgggtcagctccaagtgggtcaggaagttcctgggtgcagggggatgatccaagcatgtccctcacccagaagggcgatggggagagtcaacctcaattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttgggaattgg

SEQ ID NO: 189110 - DNA, 594 bp, Homo sapiens
  Payload ID: 17345
  Gene Symbol: TNKS1BP1
  Gene Name: tankyrase 1 binding protein 1, 182kDa
  ENST ID: ENST00000527207
  CDS Start-End: 165-594
gtgattcacagacagacttcatactttgcagctctctagctctgctttgagtagacacctccagcggggccgtcctacccaaggggcactgtggggactgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacgga

SEQ ID NO: 189111 - DNA, 5952 bp, Homo sapiens
  Payload ID: 17345
  Gene Symbol: TNKS1BP1
  Gene Name: tankyrase 1 binding protein 1, 182kDa
  Uniprot ID: Q9C0C2
  ENST ID: ENST00000532437
  CDS Start-End: 313-5502
cagtgagtgactccctgaagcgctaggactttggggttaggagataagagttggggaggatctttgaagagttgaggatatggctgttgggaacctcccttgacctcctcctacccccccccccccactccaagttctctcttcctgtcccacactctgcctctgttagaaataggagacttctctctgctaaacctactggcaacgcccaactctttttttccttctcttctctctcttttcctaggtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaaaccccgggccctgcctgccaagccagccctgcctgccaaacccagcctgctggtgcctgttgggcctcggcctccccggggtcccctggctgagttgccttctgccaggaagatgaacatgctggcaggaccccagccctatggtggcagcaagcgcccccttccctttgcaccaaggcctgcggttgaggcctccactggaggagaagccacccaagagactgggaaagaggaggctgggaaagaggagccaccccctttgacacccccagctcgatgtgcagccccagggggtgtacggaaggcccctgcccctttccgcccagcctcagagcgcttcgcggccaccacggtggaagagatcctggccaagatggagcagcctcggaaggaggtccttgccagccccgaccgcctgtggggttcccgcctcacctttaaccacgatggcagctcgcgatatggccccaggacctatggcacgaccactgctcccagggatgaggatggcagcaccctcttcaggggatggtcccaggaggggccagtaaagtctccagcagagtgccgggaagagcacagcaagacccctgaggagaggagccttccttccgacctggccttcaacggggacctggctaaggcagccagctcggagctacctgctgatatttccaagccctggattccctcaagtccagccccctcctcagagaatggaggccctgccagcccaggcctccccgcagaagcctcaggctcaggccctggctctccccatcttcacccgcctgataagagttctccctgccactcacagcttctggaagcccagactcctgaagcttcccaggcttctccctgccccgctgtgactccatcagctccaagtgcagccctgcctgacgagggctcccgccacacccccagcccggggctccctgccgagggggctccagaggcccccagacccagcagcccaccccctgaggtcttggagccccatagcctggatcagccccctgccacctcaccccggcccctgatcgaggtgggtgagttgctggatctcactcggacgtttccatctggcggggaggaggaggccaagggtgacgcacacctccgccccaccagcctggttcagcgccgattctctgaaggtgtgctccagtcacccagtcaggaccaggagaagctggggggctcgctggctgccctgccccaaggccaggggagccagttggccctggatcgtccctttggggcagagtccaactggagcttatcacagtccttcgaatggaccttccccacgaggccctcgggtctgggcgtgtggcggctggactccccgcctccctcccccatcactgaagccagtgaggccgccgaggctgctgaggctggcaacttggccgtttccagcagggaagaaggagtgtctcagcaggggcaaggggctgggtcagctccaagtgggtcaggaagttcctgggtgcagggggatgatccaagcatgtccctcacccagaagggcgatggggagagtcaacctcaattcccagctgttccccttgagcccctgcctacaactgagggcacacctggattacctttgcagcaggcagaggagagatacgagtcgcaggagcccttggctggacaggagtcccctctccccctggctaccagggaggcagccttgcccatcctggagccagtcctggggcaggagcagccagcagcccctgaccagccctgtgttctctttgctgatgcccctgagcctggacaggcactgcctgttgaggaggaggccgtgaccctagcccgggctgagaccacccaagccaggacagaggctcaagacttgtgtagggcatcccccgagcctccaggccctgaaagcagctcccgctggctggacgacctcctggcttcaccaccacccagtggtggcggtgcaaggcggggagctggagctgagctgaaggacacacagtccccaagtacctgctctgagggactccttggctggtcccagaaagatctgcagagtgaatttgggatcacaggagacccacagcccagcagtttcagtccttccagctggtgtcaaggtgcttctcaggactatggccttgggggtgcaagccctagaggagacccaggtctcggagagagggactggaccagcaagtatgggcaaggagcaggggaagggagcaccagggagtgggccagcaggtgtggcatcggccaggaggagatggaggccagcagcagccaagaccagagtaaagtgtctgccccaggggtgctcacagcccaggaccgggtagttggaaagccagcccagcttggcactcagcggagccaggaggcagatgttcaggactgggagttcagaaagagggattcccagggcacttactccagccgggatgcagaactccaggaccaggaattcggaaagagagattcactgggtacctacagtagtcgagatgtaagccttggggactgggaatttgggaagagagattctctgggtgcttatgccagccaagatgccaacgagcagggccaagatttggggaagagggaccaccatggtaggtacagcagccaggatgccgatgagcaggactgggagtttcagaagagagatgtgtcactcggcacctatggcagccgggctgcggagccacaggaacaggagtttgggaagagcgcttggataagggactacagcagtggtggcagctccaggacccttgacgcccaggacagaagctttggaacgagacccctgagctctgggttcagccccgaggaagcccagcaacaggatgaggaatttgagaagaagattccaagtgtggaagacagccttggagagggcagcagggatgctggccggccaggagagagaggatccgggggcttgttcagtcctagcactgcccacgtgccggatggggcactcgggcagagagaccagagcagctggcaaaacagtgatgctagccaggaggtgggagggcatcaggagagacagcaggcaggggctcagggccctggcagtgctgacctggaagatggggagatgggaaagcgaggctgggtcggtgagtttagcctcagtgttggcccccagcgagaggcagcatttagcccagggcagcaggactggagccgggacttctgcatcgaggccagtgagaggagctatcagtttggcatcattggcaacgacagagtgagtggtgctggctttagcccttctagcaagatggaaggtggtcactttgtgcctcctgggaagaccacagctggctcggtggactggactgaccagctgggtctcaggaacttggaagtgtccagctgtgtgggttctgggggctcgagcgaggccagggagagtgccgtgggacagatgggctggtcaggtggcctgagcttgagagacatgaacctgaccggctgtttggaaagtggagggtctgaagagccggggggaatcggagttggggagaaggactggacttctgatgttaatgtgaagagcaaagatttggctgaggtcggggagggaggaggccacagccaggccagagagagtggcgtggggcagactgactggtcaggtgtggaggccggagagttccttaaatcaagggagcgtggagttggacaggcagactggacacctgaccttgggctgagaaacatggccccaggggcagtctgcagtcctggagagtccaaagagcttggggtgggccagatggactggggtaacaatctgggcctgagggatttggaggtgacctgtgacccagactctggaggttctcaggggctacggggatgtggagtggggcagatggactggacccaggacttggcgccccagaatgtggagctctttggggctccaagtgaagccagggagcatggggtgggcggggtgagccagtgcccagagcccggcctgaggcacaatggcagcttgtctcctggcctggaggccagagaccccttggaggccagggagctgggggttggtgagacaagtgggccagagacccagggtgaagattactcctcgtcttccttggagccacaccctgcagaccctggaatggagacaggagaagccctcagcttcggagcaagccctggcaggtgcccggcccgccccccaccctccggctcccagggcctgctggaggagatgctggcagccagcagctccaaggcggtggctcggagggagtcagcggcctcgggccttgggggcctgttggaggaggaaggagccggggcaggtgctgcccaagaggaggtgctggagcctggcagggactctccaccctcctggaggccgcagcctgatggtgaggccagccagacagaagacgtggatggcacctggggctcttcagcagccaggtggagcgatcaggggccagcacagacttctcggcgaccctcccaaggccctcctgccagatcccccagtcaggacttctccttcattgaggacaccgagatcctcgacagtgccatgtatcggagccgtgccaacttggggcgcaagcgtgggcaccgggccccggtcattcggcctgggggtaccttgggcctgtcggaggcagcagactcggatgcacacctgttccaggactctacagagccacgggcatctcgggtgccatcttcagatgaagaggtagtggaggaacctcagagccgccggacacggatgtcgttgggcaccaaggggctgaaagtcaacctctttcctggcctgagcccctcagccctgaaggccaagctgcgcccccggaatcgctcagctgaggagggagagctggctgagagcaagtcgagccagaaggagtccgcggtccagcgttcgaaatcctgcaaggtcccaggactgggaaagcccctcacgttacctcccaagccagagaaatcctcagggtcagaaggatcgtcgcccaactggcttcaagccctgaaactgaagaagaagaaggtctgagaagtcactgaggttcttcccacctggcagtctcaggcagtgcccattcctgtggggtccctgggtgaggagacggctggagccccaccatgccccaggctgcagcctctgtcccctccacctctgaggagcgtctggggaggcacatttatgcactttgtatcaccctccgaactccccccacaccttcccttccctggatttcatcactagtggttgaaggttttgtcccttcctctcctccttccctctccctctctgcttcctcctccagcctcccttgggttttcttttgataccaatttatagcattttttataaaagcctttgatttttataatgggtgggactgtatccctgcctcaccccaggtctccgtctgccccgccaggtaccccacagagaccaatgacattttgccacttgaaacaataaataaagttttttggg

SEQ ID NO: 189112 - DNA, 9620 bp, Homo sapiens
  Payload ID: 17346
  Gene Symbol: TNKS
  Gene Name: tankyrase, TRF1-interacting ankyrin-related ADP-ribose polymerase
  Uniprot ID: O95271
  ENST ID: ENST00000310430
  CDS Start-End: 27-4010
agtgacagtgctaggggagtccgaagatggcggcgtcgcgtcgctctcagcatcatcaccaccatcatcaacaacagctccagcccgccccaggggcttcagcgccgccgccgccacctcctcccccactcagccctggcctggccccggggaccaccccagcctctcccacggccagcggcctggcccccttcgcctccccgcggcacggcctagcgctgccggagggggatggcagtcgggatccgcccgacaggccccgatccccggacccggttgacggtaccagctgttgcagtaccaccagcacaatctgtaccgtcgccgccgctcccgtggtcccagcggtttctacttcatctgccgctggggtcgctcccaacccagccggcagtggcagtaacaattcaccgtcgtcctcttcttccccgacttcttcctcatcttcctctccatcctcccctggatcgagcttggcggagagccccgaggcggccggagttagcagcacagcaccactggggcctggggcagcaggacctgggacaggggtcccagcagtgagcggggccctacgggaactgctggaggcctgtcgcaatggggacgtgtcccgggtaaagaggctggtggacgcggcaaacgtaaatgcaaaggacatggccggccggaagtcttctcccctgcacttcgctgcaggttttggaaggaaggatgttgtagaacacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacattagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggtcacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgagaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttccctctttcctaaattactagtctggaattaaaattagctccagcaatgacctttgactccattcattttctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagta

SEQ ID NO: 189113 - DNA, 574 bp, Homo sapiens
  Payload ID: 17346
  Gene Symbol: TNKS
  Gene Name: tankyrase, TRF1-interacting ankyrin-related ADP-ribose polymerase
  ENST ID: ENST00000517770
  CDS Start-End: 1-186
cttgggaaatcctttctgcagtttagcaccatgaaaatggcccacgcgcctccagggcaccactcagtcattggtagaccgagcgtcaatgggctggcatatgctgaatatgtcatctacagaggagaacaggtggatactctaaaggcacgacatctctgcagcattccagccaaaaatacatgatgcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaa

SEQ ID NO: 189114 - DNA, 1964 bp, Homo sapiens
  Payload ID: 17346
  Gene Symbol: TNKS
  Gene Name: tankyrase, TRF1-interacting ankyrin-related ADP-ribose polymerase
  ENST ID: ENST00000520408
  CDS Start-End: 27-1880
agtgacagtgctaggggagtccgaagatggcggcgtcgcgtcgctctcagcatcatcaccaccatcatcaacaacagctccagcccgccccaggggcttcagcgccgccgccgccacctcctcccccactcagccctggcctggccccggggaccaccccagcctctcccacggccagcggcctggcccccttcgcctccccgcggcacggcctagcgctgccggagggggatggcagtcgggatccgcccgacaggccccgatccccggacccggttgacggtaccagctgttgcagtaccaccagcacaatctgtaccgtcgccgccgctcccgtggtcccagcggtttctacttcatctgccgctggggtcgctcccaacccagccggcagtggcagtaacaattcaccgtcgtcctcttcttccccgacttcttcctcatcttcctctccatcctcccctggatcgagcttggcggagagccccgaggcggccggagttagcagcacagcaccactggggcctggggcagcaggacctgggacaggggtcccagcagtgagcggggccctacgggaactgctggaggcctgtcgcaatggggacgtgtcccgggtaaagaggctggtggacgcggcaaacgtaaatgcaaaggacatggccggccggaagtcttctcccctgcacttcgctgcaggttttggaaggaaggatgttgtagaacacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacattagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaaggtgaggcacacacctgagcagagtgccagactcagcactgagcagccagctgctcttaacactgcttctctctctccgatttttctgaagaaactaattttataaaggactattagttcgtacttaaattcatggattctcctataaagctgatttagatcttgtttctaataaaaataattacccgtg

SEQ ID NO: 189115 - DNA, 3897 bp, Homo sapiens
  Payload ID: 17346
  Gene Symbol: TNKS
  Gene Name: tankyrase, TRF1-interacting ankyrin-related ADP-ribose polymerase
  ENST ID: ENST00000518281
  CDS Start-End: 432-3704
aataccgttgataaactgctatgtgtgcctggattgcctttgtcttgacaaattgtgtgagacaagtgaatctctccattatctttttattttcttttgacacggagtctcgctctgttgcccaggctggagtataggggcgcgatctcggctcattgcaagctccgcctcccgggttcacgccattctcctgcctcagcctccggagtagctgggactacaggcgcccgccaccacgcagggctaattttttgtatatttagtagagacgggtttcaccatgttagctaggatggtctcgatttcctgacctcgtgatccgcctgcttcggcctccctaaattacaggtgtgagccaccgcgcccggcggataattttttaagaggaacaaggttttggaaggaaggatgttgtagaacacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattgtgctgctgcagcacggagctgacccaaacattcggaacactgatgggaaatcagccctggacctggcagatccttcagcaaaagctgtccttacaggtgaatacaagaaagacgaactcctagaagctgctaggagtggtaatgaagaaaaactaatggctttactgactcctctaaatgtgaattgccatgcaagtgatgggcgaaagtcgactcctttacatctagcagcgggctacaacagagttcgaatagttcagcttcttcttcagcatggtgctgatgttcatgcaaaagacaaaggtggacttgtgcctcttcataatgcatgttcatatggacattatgaagtcacagaactgctactaaagcatggagcttgtgttaatgccatggatctctggcagtttactccactgcacgaggctgcttccaagaaccgtgtagaagtctgctctttgttacttagccatggcgctgatcctacattagtcaactgccatggcaaaagtgctgtggatatggctccaactccggagcttagggagagattgacttatgaatttaaaggtcattctttactacaagcagccagagaagcagacttagctaaagttaaaaaaacactcgctctggaaatcattaatttcaaacaaccgcagtctcatgaaacagcactgcactgtgctgtggcctctctgcatcccaaacgtaaacaagtgacagaattgttacttagaaaaggagcaaatgttaatgaaaaaaataaagatttcatgactcccctgcatgttgcagccgaaagagcccataatgatgtcatggaagttctgcataagcatggcgccaagatgaatgcactggacacccttggtcagactgctttgcatagagccgccctagcaggtcacctgcagacctgccgcctcctgctgagttacggctctgacccctccatcatctccttacaaggcttcacagcagcacagatgggcaatgaagcagtgcagcagattctgagtgagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaaccgcgtgtctgttgtagagtacctgctacaccacggtgccgatgtccatgccaaagacaagggtggcttggtgccccttcataatgcctgttcatatggacactatgaggtggctgagcttttagtaaggcatggggcttctgtcaatgtggcggacttatggaaatttacccctctccatgaagcagcagctaaaggaaagtatgaaatctgcaagctccttttaaaacatggagcagatccaactaaaaagaacagagatggaaatacacctttggatttggtaaaggaaggagacacagatattcaggacttactgagaggggatgctgctttgttggatgctgccaagaagggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaagttgctggtcttgacatgaatatcagccaatttctaaaaagccttggccttgaacaccttcgggatatctttgaaacagaacagattacactagatgtgttggctgatatgggtcatgaagagttgaaagaaataggcatcaatgcatatgggcaccgccacaaattaatcaaaggagtagaaagactcttaggtggacaacaaggcaccaatccttatttgacttttcactgtgttaatcagggaacgattttgctggatcttgctccagaagataaagaatatcagtcagtggaagaagagatgcaaagtactattcgagaacacagagatggtggtaatgctggcggcatcttcaacagatacaatgtcattcgaattcaaaaagttgtcaacaagaagttgagggagcggttctgccaccgacagaaggaagtgtctgaggagaatcacaaccatcacaatgagcgcatgttgtttcatggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctt

SEQ ID NO: 189116 - DNA, 2900 bp, Homo sapiens
  Payload ID: 17346
  Gene Symbol: TNKS
  Gene Name: tankyrase, TRF1-interacting ankyrin-related ADP-ribose polymerase
  ENST ID: ENST00000522110
  CDS Start-End: 9-740
gtccgaagatggcggcgtcgcgtcgctctcagcatcatcaccaccatcatcaacaacagctccagcccgccccaggggcttcagcgccgccgccgccacctcctcccccactcagccctggcctggccccggggaccaccccagcctctcccacggccagcggcctggcccccttcgcctccccgcggcacggcctagcgctgccggagggggatggcagtcgggatccgcccgacaggccccgatccccggacccggttgacggtaccagctgttgcagtaccaccagcacaatctgtaccgtcgccgccgctcccgtggtcccagcggtttctacttcatctgccgctggggtcgctcccaacccagccggcagtggcagtaacaattcaccgtcgtcctcttcttccccgacttcttcctcatcttcctctccatcctcccctggatcgagcttggcggagagccccgaggcggccggagttagcagcacagcaccactggggcctggggcagcaggacctgggacaggggtcccagcagtgagcggggccctacgggaactgctggaggcctgtcgcaatggggacgtgtcccgggtaaagaggctggtggacgcggcaaacgtaaatgcaaaggacatggccggccggaagtcttctcccctgcacttcgctgcaggtcagagacttttgaattgtttattaagggttatgggtttgggtgcagggtccggttaggacaagaaaacaggttattgtgatgggacaaagtgggggcgtggttatggttcttcatcacctcaccagaagactggaggttcctttcttttggtggtgcctgggtgatgggggcgtggttgggggggataagtgaatccaaggaattcttcagtggttgcacagtactcattacaaaactcactgtagttggtagtctctgcatatggatatatttacactttagtttttggtgtgcaggaatacagttagatttggacagctttagagtagttttgtcgtttgtgtgctagtttattttgtttttacaagggtatgtcctttgaggacagtccagaccaaaagaggtttaatacaacccaacacatgtttgaggatctattgtagccttaataacccaatgaaagacataaatgaagtgtttgaaagtttcccttcttctaaagaagtttgcagtctagacggggagaccaaaatatgccaatgtgaaacaactggagaagaatatttggatgcattatatgatgatggaagaaatataggctttgatgttgtggccactattatttgttgtctagcagaccatttacctcgtgtcagttgcctcagttttctcatgggcaaaaatcataaaatgatgttgtgcgagcatttggtgagaagtatctggcacaaagttctccctcaaaaagtgtgaatttcttaagctctggaccccacacttgtctttttttttttttttgcaagtagttgatgattttctctcaaagacacctaataatatgtttataaaataaagagaactgtaaaataaaaacaaaggaccataatctcactgcctggatacctattgttgatattttaaaaatgtaggtaataatgttttatacattagaaacattatattggaaatacatatattgtacgttatacaattcaaataggacagaaaaatacaaaatgaaaggcatcacacagaaacatcagagataacacaccagagataacttctgttaagtttctcctatatttctaatatatatatatatcacttcttcagtttgttctgttaacagtaaaacatgtgttgacccactgtagtatttatttttaccacacttgggagatatgattaaccattttacagatgacaaaagtgaagcatatatcgatcgcttaaataagtccaaattcagtcaggaaatagtggaaattgagtttgaattcaggcagtttgattttagagcttgtgaaatcaaacttaaactgtcagaaccctggattaaggtcacttttcatttttgtgagtaattgaagtgtagagttcccaatttttgggagaagtagtaatgcggaggggcttatatgcaagagagtagctttcacatgttttttattgtagcccatacttagaaatacattttacattgtcacatacgcaactgaatcaaaagtttctggaaacaatactttcccttaatacatgtgttgtcctctgatattttatattttattctgtttcatttttagcaaatgctgcttgtgatccattaatgggtcgtgaccagtggtatgagaaacacttaaaggaaatcattgttaggtcactggattcattattgatatacagacactacttattaggaatgcagtgaattgaatcagaaacagacttttgcctatttgtttgctcaagggtcttgcttgttttagatgaaatagcatttctttttccttaggctaaatgaaaggcctaagtctgattttattaatcaacagaggtgtctacttttgcatactttattccaagtttgcctattttaacaaattgcgtcacaaatcatgtcatttctcaccatcccactttatgcgtaatcaccaataaatgatagttatatttatgtgtattaatgtatttaggataagtcacacaaaatagtgcttgtttctcaaatcacgtgtcttctatttgccacaatagttacttgttattctgtttcagagttttatgtatatccagataagctagaagataaacaatcaaacagtaccgtaattatgttgtagttatgacaagctaaccttgaattggctttttaagaaagtttttagctcagttgtggaaaacacagtaataaaattctcgatatgaaaacataa

SEQ ID NO: 189117 - DNA, 503 bp, Homo sapiens
  Payload ID: 17346
  Gene Symbol: TNKS
  Gene Name: tankyrase, TRF1-interacting ankyrin-related ADP-ribose polymerase
  ENST ID: ENST00000518635
  CDS Start-End: 1-207
ggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggtagtaaaagttggattccaagacctcctttccagcttgttgtaatgattaaatgagaccatgcatgtggaaattgcattaactaatgtaaggcattataaaaatgcaagcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacag

SEQ ID NO: 189118 - DNA, 6157 bp, Homo sapiens
  Payload ID: 17347
  Gene Symbol: TNKS2
  Gene Name: tankyrase, TRF1-interacting ankyrin-related ADP-ribose polymerase 2
  Uniprot ID: Q9H2K2
  ENST ID: ENST00000371627
  CDS Start-End: 380-3880
cgcgccgcctcgctagccgaaacctgcccagccggtgcccggccactgcgcacgcgcgggacgacgtcacgtgcgctcccggggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattgtgctgttacagcatggagctgagccaaccatccgaaatacagatggaaggacagcattggatttagcagatccatctgccaaagcagtgcttactggtgaatataagaaagatgaactcttagaaagtgccaggagtggcaatgaagaaaaaatgatggctctactcacaccattaaatgtcaactgccacgcaagtgatggcagaaagtcaactccattacatttggcagcaggatataacagagtaaagattgtacagctgttactgcaacatggagctgatgtccatgctaaagataaaggtgatctggtaccattacacaatgcctgttcttatggtcattatgaagtaactgaacttttggtcaagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatatgaatttaaaggccactcgttgctgcaagctgcacgagaagctgatgttactcgaatcaaaaaacatctctctctggaaatggtgaatttcaagcatcctcaaacacatgaaacagcattgcattgtgctgctgcatctccatatcccaaaagaaagcaaatatgtgaactgttgctaagaaaaggagcaaacatcaatgaaaagactaaagaattcttgactcctctgcacgtggcatctgagaaagctcataatgatgttgttgaagtagtggtgaaacatgaagcaaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaagagggtatctcattaggtaattcagaggcagacagacaattgctggaagctgcaaaggctggagatgtcgaaactgtaaaaaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaaggaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccagcatggtgcagaccctacaaaaaaaaacagggatggaaatactcctttggatcttgttaaagatggagatacagatattcaagatctgcttaggggagatgcagctttgctagatgctgccaagaagggttgtttagccagagtgaagaagttgtcttctcctgataatgtaaattgccgcgatacccaaggcagacattcaacacctttacatttagcagctggttataataatttagaagttgcagagtatttgttacaacacggagctgatgtgaatgcccaagacaaaggaggacttattcctttacataatgcagcatcttacgggcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggaggttccaggagtagattttagcataactcaattcgtaaggaatcttggacttgagcacctaatggatatatttgagagagaacagatcactttggatgtattagttgagatggggcacaaggagctgaaggagattggaatcaatgcttatggacataggcacaaactaattaaaggagtcgagagacttatctccggacaacaaggtcttaacccatatttaactttgaacacctctggtagtggaacaattcttatagatctgtctcctgatgataaagagtttcagtctgtggaggaagagatgcaaagtacagttcgagagcacagagatggaggtcatgcaggtggaatcttcaacagatacaatattctcaagattcagaaggtttgtaacaagaaactatgggaaagatacactcaccggagaaaagaagtttctgaagaaaaccacaaccatgccaatgaacgaatgctatttcatgggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggcagctgctcttttgccgggtaaccttgggaaagtctttcctgcagttcagtgcaatgaaaatggcacattctcctccaggtcatcactcagtcactggtaggcccagtgtaaatggcctagcattagctgaatatgttatttacagaggagaacaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccacgcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtt

SEQ ID NO: 189119 - DNA, 12407 bp, Homo sapiens
  Payload ID: 17348
  Gene Symbol: TAOK1
  Gene Name: TAO kinase 1
  Uniprot ID: Q7L7X3
  ENST ID: ENST00000261716
  CDS Start-End: 520-3525
cttaccaggggtggtgttggtggcggagggctgcgcgtgggcccgcccgccgaggggccgcggcgggggaccgagagggcctcggctgtgtgaggactagaggcggccgaggcccgggccggttcccccgaggcggcgacggagacggctcccggcacttccccgcgccatcttaactgagcccaagcgctgagggcgcctcctcgaccccggtcgtcccctcgcccccccccccaccccccgccgccgccgccccttgttgcagagcttgggctgggcggcttgctggggctcgggggtggggggcggcgatctgtcgccgggccccctcctcctcctcactcctcaccctccagggtagcggctaccggagcgctgcagggggctgcgcctgcctgctccgccccagacctgtcggcgaaaggtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgcacgagatgtgcgtaccaatgaagtggtggccatcaagaaaatgtcttatagtggaaagcagtctactgagaaatggcaggatattattaaggaagtcaagtttctacaaagaataaaacatcccaacagtatagaatacaaaggctgttatttacgtgaacacacagcatggcttgtaatggaatattgtttaggatctgcttcggatttactagaagttcacaaaaagccattacaagaagtggaaatagcagcaattacacatggtgctcttcagggattagcctacttacattctcatactatgattcatagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgccatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagaggagctaaatgaaaaccagagtacccccaaaaaagaaaaacaggagtggctttcaaagcagaaggagaatatacagcatttccaagcagaagaagaagctaaccttcttcgacgtcaaagacaatacctagagctggaatgccgtcgcttcaagagaagaatgttacttgggcgtcataacttagagcaggaccttgtcagggaggagttaaacaaaagacagactcagaaggacttagagcatgccatgctactccgacagcatgaatctatgcaagaactggagttccgccacctcaacacaattcagaagatgcgctgtgagttgatcagattacagcatcaaactgagctcactaaccagctggaatataataagcgaagagaacgagaactaagacgaaagcatgtcatggaagttcgacaacagcctaagagtttgaagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccctgcgtttggatgaagcacaggaagcagagtgccaggttttgaagatgcagctgcagcaggaactggagctgttgaatgcgtatcagagcaaaatcaagatgcaagctgaggcacaacatgatcgagagcttcgcgagcttgaacagagggtctccctccggagggcactcttagaacaaaagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgcagtactttacaaacttctagttcgttgagacttagtgaccatttggcatcaagttaacatcacacaataggaaacaccacttccacaagtctcaagcctcagtgctaaagtactactgaaaaggaactaggaagtttggccaattaaaaaaaaaaagtaaaataagttatagtggtcagggaatctcttgacgaaagctaactcttatttttcagggggcacatgttttgttttgttatgttttgttgtacaatgaaggatgaacccaatgctaaaaagtcagttattttcttggttttccatttcttgtatataaattgtgttggaggtgggtaggaagctgtgagtatgacttgaagaaaaatatccttttcagtgacaaatcagagtttcttacaagttattgtcctgctcccttccaagttgtcttgaagaatccttgctgctaactctggatcctgcttttcctatagtcagagggctccaaggtagaactctctaagtccctctcaatggcactctttgcctagaccaaactaatgaccaaacagtaatcaatctatcactgttgaagtcctggttttctcaaccaaattttaagtctttcccaggtatgtcagtcgagttgccatgaatcctcacctgtaggagtttctgggattcattttaaggaaactggaagaaaattaatgttttaatgtaaatgtttttaaaaccaagatcaccatagagttcacacaaaattttaggcagtgtttcaagaagcactcttatgtgttgttctttcagcccatgctccaggtcaccggtttttaggtaaacatgacatgacatgtacttgtaatatcagtgaaaggggcttttagtcgtctcagtatcttttttgcattcaggtattatagcgtttccaacaaattgagaaattacttatttggtgtaaaatgacgagagagctttagaatttaataaaatgtcaaaaatacaatttgatacccttaaaaattattcatagatctggctgctctgtactactggatgggtggaatagggaagcagatcacttttgcatacaaaaactctttcaaacccaaaatattattggtggtacattttaaagtccaattgtggacttaaattagtcaaattgagagttactgagtccattcagatctccagtagggttttgtatctaatgtatttggccaccagttttacatgtaggtcatgactatacctggattttatcattaagttaactttaaagtatatacagtttgcaaaaaatgattcaaattaattggtttgtatatgtttgtgagatctagcttctgaggaatctcatacatagtaggaaccatcatagagtaaagcttgtagcagaaaaattggaagggttttgagatatcctagagaaagagcaagcactttctgaatcagtggggaaatatcaatatttgatcaaattaacactacctccttcccagtgttggtgttcactcactatatgtctttaagaaaattaaaactatggaaaatttgtctagcatatcagaagttgtaaatgctatatctggtatccagaggctggctgtaaaaagttccttggggtcactctatctcacattttttttggttagcattttaaaaatgcaaagccacatactttgaaatatattattccaaattgagctcccttccctttgcacatattttttcctccccttattgaagtcagctctaaccccaaattctagtatccaaaagtatttttatttgtataatgctatctgaaaaatgtgtttatattatattttcagagctgcaattcttattcgccatttcaatacctagagatagagagtcttgtatttgaagccacacacactggtgtaatatgcttagtactctaggtcaaggatttgttggtaaatggaacattttagcatagtcatgatttttggttgcctagacatcaggtaaacattcagtacactaaagaaactatcctggacactccctcctgcttccaccaatttttttctcacccccttttcaaaaattgaaaactctatgagtgtctttttgagaccataaagcagactttagtaactttctatttctgtaagtactaaatgtctggcattttaaacttttgtagaatacattatgttggacactggaataatactatttattttcacctgtgaaaaatgacttcattgtacttgaaacacctcctttgcatttctccatttgtgccattcactagtggaaataaattgtattataccatgatctactggctttttaaaactgtattaaatatgcacatttttggtatagctattatcatttgtatgtatatattgtatatacatatgagtgtctgtatgtgtgtatagatggatggatgtaactcatactgtacatttccatcagggcacttaaaagttctgttatttttgtttggttttgttatttcagtcctcagttaaggcaagaatgcatgtgtttcttaagaatgagtactctgcgttgatgtttatgagaaggtggtcattagatgcagtcttttcctttttaatcccctcttagcacttctgtgagtggagaggacattaagtaaaatttggaatcataagttgcaatgcagtaaaatggtgctggggaaggagccagttagtgtttctgtgagtttgtgttgtgatgcaataagagataagtaatgcagagagaaatgaaccatggaaagtaagaacactgatggtgattcctctgcaaagatgataagaaaaagaaccaataaatcacacaatctttatgtgctttctatatgtatttcttagtagtgataccattgatcctcttactttttttactccattaatactaataattatatactttgctgaggatcaaaacagccaagaaaggaattactgctaaagcatctaagattctcctgaactgtaaaatcaacaggaaatggccactgggagagaaggatttggtattgggtgaggggctttctccctttacctgcctcttcttgcttgctaatagtaagttctttgtgcaccttccaccacttctgagccactactattcaagtagagatttgccccaacacattaactttttccttggagatttatatggtcctgcattttgtcctgtgctcacaatgtgaagtgtcttctgtattcaaatcaaaaaataatatatttaaggtatataagtgtgaatctcctataatgatggaagaagaggttctcttgtcttagatagaaaagagccttctccaagagcaatgtcaaaacttgggctgtcatctttgagctgtttaccaaaatacagaccattattgaagaaaaacaaattatctattttgttttcccccatctaacatgatagtgcccccaaccaggttgtagcattgccttttaaaagagactcactcactcttagtttttaagaactggaaatttcccatcctcagatcccttaaaggatgaagagttggctgtacacttagcggacttgcctcttgtatgcaaggactactgattgaagtctgttttgctgtgtctggttatgttgtctgcacttttatgaaatcactacaataggtctgcattggaaatgactattaatttgtaaagaagtaagttttattaaacactgtctagaaaaagaaagtgaagctgagaactcttcctttattgtgcatttatattttctgctgaattccggtagttccctttaaagtcatgttgactaatgttttcctccttgtttgtattcagatttccaaaatttcactcatacaagggaagagactccatttagcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagagttacatatgttcttttgtcattacccaatttaacctccctttctctgatatgccttgtagccaaagtattaaaggctgatgaacatagacaagggaaatgcatttcttagaaatccgtgaaccctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacacag

SEQ ID NO: 189120 - DNA, 4068 bp, Homo sapiens
  Payload ID: 17348
  Gene Symbol: TAOK1
  Gene Name: TAO kinase 1
  Uniprot ID: Q7L7X3
  ENST ID: ENST00000536202
  CDS Start-End: 189-2750
ctcctcctcactcctcaccctccagggtagcggctaccggagcgctgcagggggctgcgcctgcctgctccgccccagacctgtcggcgaaaggtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgcacgagatgtgcgtaccaatgaagtggtggccatcaagaaaatgtcttatagtggaaagcagtctactgagaaatggcaggatattattaaggaagtcaagtttctacaaagaataaaacatcccaacagtatagaatacaaaggctgttatttacgtgaacacacagcatggcttgtaatggaatattgtttaggatctgcttcggatttactagaagttcacaaaaagccattacaagaagtggaaatagcagcaattacacatggtgctcttcagggattagcctacttacattctcatactatgattcatagagatatcaaagcaggaaatatccttctgacagaaccaggccaggtgaaacttgctgactttggctctgcttccatggcatcacctgccaattcctttgtgggaacgccgtattggatggccccagaagtaattttagccatggatgaaggacaatatgatggcaaagtagatgtgtggtctcttggaataacatgtattgaactagcggaaaggaagcctcctttatttaatatgaatgcaatgagtgccttatatcacatagcccaaaatgaatcccctacactacagtctaatgaatggtctgattattttcgcaactttgtagattcttgcctccagaaaatccctcaagatcgacctacatcagaggaacttttaaagcacatatttgttcttcgggagcgccctgaaaccgtgttaatagatctcattcagaggacaaaggatgcagtaagagagctggacaatctgcagtatcgaaagatgaagaaactccttttccaggaggcacataatggaccagcagtagaagcacaggaagaagaagaggaacaagatcatggtgttggccggacaggaacagttaatagtgttggaagtaatcaatccattcccagcatgtccatcagtgccagcagccaaagcagtagtgttaacagtcttccagatgtctcagatgacaagagtgagctagacatgatggagggagaccacacagtgatgtctaacagttctgttatccatttaaaaccagaggaagaaaattacagagaagagggagatcctagaacaagagcatcagatccacaatctccaccccaagtatctcgtcacaaatcacactatcgtaatcgagaacactttgctactatacggacagcatcactggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgccatggagaaagaggctaaagtgatgtccaatgaagagaaaaaatttcagcaacatattcaggcccaacagaagaaagaactgaatagttttctcgagtcccagaaaagagagtataaacttcgaaaagagcagcttaaagagtctaaagaactccaaataaaaaagcagtttcaggatacctgcaaaatccaaaccagacagtacaaagcattaagaaatcacctgctggagactacaccaaagagtgagcacaaagctgttctgaaacggctcaaggaggaacagacccggaaattagctatcttggctgagcagtatgatcacagcattaatgaaatgctctccacacaagccctgcgtttggatgaagcacaggaagcagagtgccaggttttgaagatgcagctgcagcaggaactggagctgttgaatgcgtatcagagcaaaatcaagatgcaagctgaggcacaacatgatcgagagcttcgcgagcttgaacagagggtctccctccggagggcactcttagaacaaaagattgaagaagagatgttggctttgcagaatgagcgcacagaacgaatacgaagcctgttggaacgtcaagccagagagattgaagcttttgactctgaaagcatgagactaggttttagtaatatggtcctttctaatctctcccctgaggcattcagccacagctacccgggagcttctggttggtcacacaaccctactgggggtccaggacctcactggggtcatcccatgggtggcccaccacaagcttggggccatccaatgcaaggtggaccccagccatggggtcacccttcagggccaatgcaaggggtacctcgaggtagcagtatgggagtccgcaatagcccccaggctctgaggcggacagcttctgggggacggacggagcagggcatgagcagaagcacgagtgtcacttcacaaatatccaatgggtcacacatgtcttatacataacttaataattgagagtggcaattccgctggagctgtctgccaaaagaaactgcctacagacatcatcacagcagcctcctcacttgggtactacagtgtggaagctgagtgcatatggtatattttattcatttttgtaaagcgttctgttttgtgtttactaattgggatgtcatagtacttggctgccgggtttgtttgtttttggggaaattttgaaaagtggagttgatattaaaaataaatgtgtatgtgtgtacatatatatacacacacatacacatatattatgcatgtggtgaaaagaattggctagataggggatttttctgaacactgcaaaaatagaacgtagcaaaatggcttcagttatcacttttgggtgtctgtatcctaagaagtttctgaaaagatctaaagcctttttatcccatatcccaaattcttatgagccactcacagcaggcagcatatgttgaaataagttattactggtacacacctgcattgcctcaccagtgtatttatttgttattaaattgatctgacttctcagcctcatttggactaaaaaaagaaagcagaaatccatgaacacattgcttctcggccttttggctaagatcaagtgtagaaatccatgaacactaaaggacttcattgattttttcagagagtagaaaacaacttagtttttcttttttcctgaatgcgtcataggcttgtgagtgatttttgtccattcaattgtgccttctttgtattatgataagatgggggtacttaaggagatcacaagttgtgtgaggattgcattaacaaacctatgagccttcaatggggaagaccagaagggtgagaggggccctgaaagttcatatggtgggtatgtcccgcagcagagtgaggagatgaagcttacgtgtcctgacgttttgttgcttatactgtgatatctcatcctagctaagctctataatgcccaagaccccaaacagtacttttactttgtttgtacaaaaacaaagacatatagccaatacaaatcaaatgccggaggtgtttgatgccatatttgcaaattgccatctattgaaattctcgtcacactacatagacataattgttatctccttttggcttatgtgattttctgtttacaagtagaatagccaattatttaaatgtttagttgccacagtgaaccaggagtcactgagccaatgactttaccagctgctgactaatcttcatcaccactgtagattttgctgcatgtgcaggtcctctatttttaattgctgttttcgttgctgca

SEQ ID NO: 189121 - DNA, 526 bp, Homo sapiens
  Payload ID: 17348
  Gene Symbol: TAOK1
  Gene Name: TAO kinase 1
  ENST ID: ENST00000583121
  CDS Start-End: 289-526
gtcccgctcgccctgcgcccttcgcgggccgaaagcactaggcactcgcgaacatctgaggcctcccggccccgggggaccccgccccgccgtccgccggccggcccgcggcctctcttccctttggtagcggctaccggagcgctgcagggggctgcgcctgcctgctccgccccagacctgtcggcgaaaggtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttcaaagaagatccagagaagctcttcacagatctcagagaaattggccatggaagctttggagcagtgtattttgcacgagatgtgcgtaccaatgaagtggtggccatcaagaaaatgtcttatagtggaaagcagtctactgagaaatggcaggatattattaaggaagtcaagtttc

SEQ ID NO: 189122 - DNA, 4246 bp, Homo sapiens
  Payload ID: 17349
  Gene Symbol: TAOK2
  Gene Name: TAO kinase 2
  Uniprot ID: Q9UL54
  ENST ID: ENST00000279394
  CDS Start-End: 404-3553
agaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaatctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcgctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacaga

SEQ ID NO: 189123 - DNA, 5169 bp, Homo sapiens
  Payload ID: 17349
  Gene Symbol: TAOK2
  Gene Name: TAO kinase 2
  Uniprot ID: Q9UL54
  ENST ID: ENST00000308893
  CDS Start-End: 1044-4751
accgccagtcgtgggacagagtgccgggctcctccccttgcaagtctagctcttctccccgcctcctccggcctggggtccgcgtggcggggcgggcgcgcactcgggcttggcggctgccggtctcccaggccgcggcagtgaggagagagggcggggctgagtcctctgcgcccccgccccctttagcccggcgtccctaccgcgcctgcgcgctcccgcccggtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtg

SEQ ID NO: 189124 - DNA, 4780 bp, Homo sapiens
  Payload ID: 17349
  Gene Symbol: TAOK2
  Gene Name: TAO kinase 2
  Uniprot ID: Q9UL54
  ENST ID: ENST00000416441
  CDS Start-End: 1174-4362
ctcccttccagtctgtcttaagtactgatgccagagaggtctgcctaagctcagtgctgtcatttcactccctgtttggagccatgagtggccccctgttgccttcaagactgaagccatccccatccttcctcccaccaacctagaggctttgcttcgtaaatgctggccctttccttcatgggctccaccctctgagtgtgtcatgaactcttccacttccttgccttggttcgtattgggtcctctgcccgaggtcagagatttggacgagcccttctcctccatcttcacagtctccatttaccattagatgccaggcccagacagttgatgaaaaatgtaagaaacggacccaagtataagaaaaagctagatctgtccattttatttctagtttttggaagagatgtggatacagagaaatattactctactattgaaaaaaatatatatcagtctgattataaatgtcaactcatactaagtcaatatcagggaagcagtgtggagaaggatgtggcaaactggagattgctgtttccatagaaagagggcagctaatgcttatctccagaccattgttatgcagtaatgtagactccatttcaccagatttaattcttaaggagaaactggaaacttgtattattatttgattattacttttggcagttaattttaaaaatcaccgtttaggccaaaacaacatgacatttgtctgggctacaagggactcttagcgactcttagcttgcacttacctttctaatctcagggctttttacaaagcccttctctgaattccctgaagatatgctagcttgaaggctcactgcatactctcaacttcccagccacttccctgtttccctcttataccagttaatactttgatgttattttttcagtcctatttaatcttttagactggaggttccttgagggtggggcctaattcttgtttttatcttccccatagcaattatcaagttatctgctccctttggcacctaagaaatattagttggggtgataactgaatggctgtccttctgccttcgttactgcttttgtggatgttattttctttgacccctattccacccgtgtgcagtggagaggatgggtgttgtattttacagaggaaggaattaactgagacgcaacaggatgatgggaacttctcaaggtcatgtggcaaggaagtcaaggaattggggtttgaacccaagtcgtctcagttccattccattgtcctctaccccctgccacctctcaccttcttccctttcacctttttctgtagctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtg

SEQ ID NO: 189125 - DNA, 4072 bp, Homo sapiens
  Payload ID: 17349
  Gene Symbol: TAOK2
  Gene Name: TAO kinase 2
  Uniprot ID: Q9UL54
  ENST ID: ENST00000543033
  CDS Start-End: 503-3871
tgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctgg

SEQ ID NO: 189126 - DNA, 4384 bp, Homo sapiens
  Payload ID: 17350
  Gene Symbol: TAOK3
  Gene Name: TAO kinase 3
  Uniprot ID: Q9H2K8
  ENST ID: ENST00000392533
  CDS Start-End: 492-3188
gtgctcggcgcagtccggtgcgattggccacccctggcaggagccgcacctcggacagcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcaca

SEQ ID NO: 189127 - DNA, 4301 bp, Homo sapiens
  Payload ID: 17350
  Gene Symbol: TAOK3
  Gene Name: TAO kinase 3
  Uniprot ID: Q9H2K8
  ENST ID: ENST00000419821
  CDS Start-End: 409-3105
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggtgagttgtcctcctgttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcaca

SEQ ID NO: 189128 - DNA, 555 bp, Homo sapiens
  Payload ID: 17350
  Gene Symbol: TAOK3
  Gene Name: TAO kinase 3
  ENST ID: ENST00000538601
  CDS Start-End: 1-555
caaaggctgttacttgaaagaacacactgcttggttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcatt

SEQ ID NO: 189129 - DNA, 594 bp, Homo sapiens
  Payload ID: 17350
  Gene Symbol: TAOK3
  Gene Name: TAO kinase 3
  ENST ID: ENST00000539872
  CDS Start-End: 539-594
tttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagaaaccaaggcttaaagggatgaagtaataaaaagctagtagaggccgggcacggtggctcacgcctgtaatcccagcactttgggaggctgaggcagacggatcacgaggtcaagagattgagaccatcccggccaacatggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatga

SEQ ID NO: 189130 - DNA, 881 bp, Homo sapiens
  Payload ID: 17350
  Gene Symbol: TAOK3
  Gene Name: TAO kinase 3
  ENST ID: ENST00000541186
  CDS Start-End: 603-881
tgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgaggcaacttttaccttgatctcttctgatatgactgaggcctatatccatcctttaaaaaattcttattaatcatgcggaagaagaaatctttccaggagcagcaaactcaggaccggagagataagataaatatataaagcttcagggtatgaagccatacacatagtagaaactgaggcaaaggaaagagttcatgtcccgcctgaaggcagtcaaatcaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaa

SEQ ID NO: 189131 - DNA, 597 bp, Homo sapiens
  Payload ID: 17350
  Gene Symbol: TAOK3
  Gene Name: TAO kinase 3
  ENST ID: ENST00000537822
  CDS Start-End: 556-597
gtagagagaaggtgctagaactgtgtacgatcatgactggaaagcaggatccctcagtgactgccgaatcttcccagcacaagatagagaggcagttcagcacaagcctacattggttctaggcagaacgatgatcctaccgaacagatctcaaataaaattaaattgagaaagcagatctttcaagggaatgaggcggaggctcgcttttatgttaaaagccaccagcatcctccttgctagacatggacatgacatttttaaaggaattatctggttacagcgttttaagcaaactgttctaaggagtctgtacattgcattattttttctattctttttttcttttgcatatatgtaattctggaggatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcag

SEQ ID NO: 189132 - DNA, 613 bp, Homo sapiens
  Payload ID: 17350
  Gene Symbol: TAOK3
  Gene Name: TAO kinase 3
  ENST ID: ENST00000542902
  CDS Start-End: 442-613
ctctttaagcctcacttaaaaaactaagtgtctgtaataacttcctttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctata

SEQ ID NO: 189133 - DNA, 641 bp, Homo sapiens
  Payload ID: 17350
  Gene Symbol: TAOK3
  Gene Name: TAO kinase 3
  ENST ID: ENST00000542532
  CDS Start-End: 534-641
agcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggctggagtgcagtggcatgattttggctgactgcaacctctgcctcccaggttcaagcaattctccggcctcagcctcccgaggagctgggactacaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttgga

SEQ ID NO: 189134 - DNA, 777 bp, Homo sapiens
  Payload ID: 17350
  Gene Symbol: TAOK3
  Gene Name: TAO kinase 3
  ENST ID: ENST00000536979
  CDS Start-End: 408-689
agaggtaggtaatgtgccaaggtgtgacacacacaaagtggatggtgtagctgtaattcaagcccaggagcctacctccaaagcccacaggtgtagccttcctgacgcctgctgctgtggtttcagatcatactgaaaagaatgtgtttggtattgtagcccattgggcagacttgactgtttttgattcccaactctgaatgtacccagagcatctgtgtttttgagggggcaaccaatttcaatccaaatgaggaaacctcttccagtagtcaccaagggctgtaggccaccaagggctgtaggcaagggtgcatgaccgtgtgtgtcttctgtgtccgcagttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccatttta

SEQ ID NO: 189135 - DNA, 590 bp, Homo sapiens
  Payload ID: 17350
  Gene Symbol: TAOK3
  Gene Name: TAO kinase 3
  ENST ID: ENST00000541786
  CDS Start-End: 527-590
gtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggttgcatcataaatacaaaggactgaagttataaaagagaaaagagaagtttgctgctaaaatgaatctgagcaatatggaatattttgtgccacacacaaaaagcatctggcacaatgtttttgtttggtttggtttggtgttgtaaagagagaggatcttgctatgtttgccagactggtctcaaactcctggtctcaagtcatcctctcaccttggcctcccaaagcattaggattacagacatgagacatcacacccagccccagcacaatgttgaatgtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgagg

SEQ ID NO: 189136 - DNA, 597 bp, Homo sapiens
  Payload ID: 17350
  Gene Symbol: TAOK3
  Gene Name: TAO kinase 3
  ENST ID: ENST00000535570
  CDS Start-End: 190-597
caggctggagtgcaatggctcaatctcggctcaccgcaacctcagcctcccgggttcaagcgattctcctgcctcagcctccctagtagctgggattacaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcc

SEQ ID NO: 189137 - DNA, 580 bp, Homo sapiens
  Payload ID: 17350
  Gene Symbol: TAOK3
  Gene Name: TAO kinase 3
  ENST ID: ENST00000540561
  CDS Start-End: 466-580
atcatgactggaaagcaggatccctcagtgactgccgaatcttcccagcacaagatagagaggcagttcagcacaagcctacattggttctaggcagaacgatgatcctaccgaacagatctcaaataaaattaaattgagaaagcagatctttcaagggaatgaggcggaggctcgcttttatgttaaaagccaccagcatcctccttgctagacatggacatgacatttttaaaggaattatctggttacagcgttttaagcaaactgttctaaggagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggaga

SEQ ID NO: 189138 - DNA, 2147 bp, Homo sapiens
  Payload ID: 17350
  Gene Symbol: TAOK3
  Gene Name: TAO kinase 3
  ENST ID: ENST00000537952
  CDS Start-End: 791-2107
agaaggtgctagaactgtgtacgatcatgactggaaagcaggatccctcagtgactgccgaatcttcccagcacaagatagagaggcagttcagcacaagcctacattggttctaggcagaacgatgatcctaccgaacagatctcaaataaaattaaattgagaaagcagatctttcaagggaatgaggcggaggctcgcttttatgttaaaagccaccagcatcctccttgctagacatggacatgacatttttaaaggaattatctggttacagcgttttaagcaaactgttctaaggagtctgtacattgcattattttttctattctttttttcttttgcatatatgtaattctggaggtaaagaaaaagcctgccagggattcagaaggcatcccactagcgatcagctgacattcctaactgaaggctgcaatgtgttgcttattcattttgtaccgtgggagctgcggggactagcagagagctaaactatgcatttcaaacagcagtgcttgtgcagaaagaggggtgagagagaggcagccggcgaggaaagagcacagctggactttctccttgtttttatccatttctgcaggatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaa

SEQ ID NO: 189139 - DNA, 578 bp, Homo sapiens
  Payload ID: 17350
  Gene Symbol: TAOK3
  Gene Name: TAO kinase 3
  ENST ID: ENST00000541878
  CDS Start-End: 394-578
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagac

SEQ ID NO: 189140 - DNA, 3684 bp, Homo sapiens
  Payload ID: 17351
  Gene Symbol: TAPBP
  Gene Name: TAP binding protein (tapasin)
  ENST ID: ENST00000374568
  CDS Start-End: 211-1611
ccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 189141 - DNA, 3766 bp, Homo sapiens
  Payload ID: 17351
  Gene Symbol: TAPBP
  Gene Name: TAP binding protein (tapasin)
  Uniprot ID: O15533
  ENST ID: ENST00000374572
  CDS Start-End: 347-1693
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaactttttttttttttttttgagactgagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 189142 - DNA, 1824 bp, Homo sapiens
  Payload ID: 17351
  Gene Symbol: TAPBP
  Gene Name: TAP binding protein (tapasin)
  ENST ID: ENST00000383065
  CDS Start-End: 172-1686
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaa

SEQ ID NO: 189143 - DNA, 3759 bp, Homo sapiens
  Payload ID: 17351
  Gene Symbol: TAPBP
  Gene Name: TAP binding protein (tapasin)
  Uniprot ID: O15533
  ENST ID: ENST00000383066
  CDS Start-End: 347-1693
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 189144 - DNA, 3677 bp, Homo sapiens
  Payload ID: 17351
  Gene Symbol: TAPBP
  Gene Name: TAP binding protein (tapasin)
  ENST ID: ENST00000383067
  CDS Start-End: 211-1611
ccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 189145 - DNA, 1824 bp, Homo sapiens
  Payload ID: 17351
  Gene Symbol: TAPBP
  Gene Name: TAP binding protein (tapasin)
  Uniprot ID: O15533
  ENST ID: ENST00000383197
  CDS Start-End: 172-1686
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaa
